(12) United States Patent
Garcia et al.

(10) Patent No.: US 9,163,064 B1
(45) Date of Patent: *Oct. 20, 2015

(54) WATER BUFFALO DERIVED MONOMERIC PEPTIDES CONTAINING PROLINE FOR ANTIBIOTIC THERAPIES

(71) Applicant: Centaur, Inc., Olathe, KS (US)

(72) Inventors: Luis Tonatiuh Melgarejo Garcia, Manhattan, KS (US); Annika Linde, Manhattan, KS (US); Gerald Henry Lushington, Lawrence, KS (US)

(73) Assignee: Centaur, Inc., Olathe, KS (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/692,518

(22) Filed: Apr. 21, 2015

Related U.S. Application Data

(63) Continuation of application No. 14/483,083, filed on Sep. 10, 2014, now Pat. No. 9,029,319.

(60) Provisional application No. 62/032,737, filed on Aug. 4, 2014.

(51) Int. Cl.
   *A01N 37/18* (2006.01)
   *A61K 38/04* (2006.01)
   *C07K 7/08* (2006.01)

(52) U.S. Cl.
   CPC .................................. *C07K 7/08* (2013.01)

(58) Field of Classification Search
   None
   See application file for complete search history.

(56) References Cited

U.S. PATENT DOCUMENTS 9,029,319 B1 * 5/2015 Garcia et al. ................... 514/2.6

OTHER PUBLICATIONS

Betts et al. Amino Acid Properties and Consequences of Substitutions. Chapter 14. Bioinformatics for Geneticists. 2003, pp. 289-316.*
Jonson et al. A critical view on conservative mutations. Protein Engineering, 2001. vol. 14, No. 6, pp. 397-402.*
Lee et al., "Salt-resistant homodimeric bactenecin, a cathelicidin-derived antimicrobial peptide", FEBS Journal, 275 (2008) 3911-3920.
Das et al., "Cloning and characterization of novel cathelicidin cDNA sequence of Bubalus bubalis homologous to Bos taurus cathelicidin-4", DNA Sequence, Dec. 2006; 17(6): 407-414.

* cited by examiner

*Primary Examiner* — Marcela M Cordero Garcia
(74) *Attorney, Agent, or Firm* — Polsinelli PC; Andrea Porterfield

(57) ABSTRACT

The present disclosure relates to antimicrobial agents and methods of using such agents. The disclosure includes antimicrobial agents having broad spectrum antimicrobial activity, nucleic acids and amino acid sequences encoding such antimicrobial agents, as well as methods of using the antimicrobial agents. The antimicrobial agents of the disclosure may be used to reduce survival of a microbe, as an antimicrobial therapeutic, in microbial treatment protocols, and in research, as well as other uses related to reducing microbe survival. In addition, the disclosure also includes compositions, as well as articles of manufacture, that comprise a broad spectrum antimicrobial agent.

11 Claims, 5 Drawing Sheets
(5 of 5 Drawing Sheet(s) Filed in Color)

1 = G
2 = L or I
3 = [(A or V or I of L) if 4 = R] or [(P) if 4 = W]
4 = [(R) if 3 = (A or V or I or L)] or [(W) if 3 = P]
5 = I or L
6 = L or I
7 = L or I
8 = R
9 = W or I or L
10 = L or I
11 = F or W
12 = [(F or W) if 13 = (R)] or [(R) if 13 = (F or W)]
13 = [(R) if 12 = (F or W)] or [(F or W) if 12 = (R)]
14 = G

WATER BUFFALO DERIVED MONOMERIC PEPTIDES CONTAINING PROLINE FOR ANTIBIOTIC THERAPIES

FIELD OF THE INVENTION

The present disclosure relates to antimicrobial agents and methods of using. More particularly, the disclosure relates to antimicrobial peptides and therapeutic uses thereof.

SEQUENCE LISTING

This application contains a sequence listing in paper format and in computer readable format, the teachings and content of which are hereby incorporated by reference.

BACKGROUND OF THE INVENTION

Antimicrobial resistance is reducing the availability of effective antimicrobial treatments worldwide. Resistant organisms, including bacteria, fungi, viruses, and parasites, are able to withstand attack by antimicrobial medicines, so that standard treatments become ineffective. Infections by such resistant organisms persist increasing the risk of spreading to others. The evolution of resistant strains of organisms is a natural phenomenon that occurs when microorganisms are exposed to antimicrobial drugs, and resistant traits can be exchanged between certain types of bacteria. The misuse of antimicrobial medicines also accelerates the emergence of resistant organisms.

With the decrease in effective antimicrobial treatments due to the emergence of resistant organisms, new antimicrobial therapeutics are needed. The number of new antimicrobial therapies developed and approved has steadily decreased in the past three decades, leaving even fewer options to treat resistant organisms.

Accordingly, a need exists for antimicrobial treatments and therapeutics having broad spectrum antimicrobial activity. Moreover, a need exists for effectively inhibiting the growth and spread of harmful microorganisms.

SUMMARY OF THE INVENTION

The present disclosure provides antimicrobial agents having broad spectrum antimicrobial activity and methods of inhibiting microorganism growth. In particular, the present disclosure is directed to peptides having antimicrobial activity and methods of using the peptides to inhibit microorganisms.

The disclosure provides synthetic antimicrobial agents having at least two 14 amino acid peptide sequences operably linked. The amino acid peptide sequence is generally the sequence of formula 1 (Gly-$X_1$-$X_2$-$X_3$-$X_1$-$X_1$-$X_1$-Arg-$X_4$-$X_1$-$X_5$-$X_6$-$X_6$-Gly) where $X_1$ is selected from the group of Leu or Ile; $X_2$ is selected from the group of Ala, Val, Leu, Ile, or Pro; $X_3$ is selected from the group of Arg or Trp; $X_4$ is selected from the group of Trp, Ile, or Leu; $X_5$ is selected from the group of Phe or Trp; and, $X_6$ is selected from the group of Phe, Trp, or Arg. In some aspects, the amino acid peptide sequence has at least 70% sequence identity to a sequence provided in SEQ ID NO: 3-33. In some aspects, the amino acid peptide sequence has at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to at least one sequence provided in SEQ ID NO: 3-33. Preferably, the amino acid peptide sequence has at least 85% sequence identity to SEQ ID NO: 8.

In some aspects, the antimicrobial agent disclosed includes a first synthetic amino acid sequence and a second synthetic amino acid sequence operably linked. Such second synthetic amino acid sequence, like the first synthetic amino acid sequence, is at least a 14 amino acid peptide sequence. Generally, the second synthetic amino acid sequence also has a sequence of formula 1 described above. In some aspects, the second synthetic amino acid sequence is identical to the first synthetic amino acid sequence, creating a homodimer. In other aspects, the second synthetic amino acid sequence is not identical to the first synthetic amino acid sequence, creating a heterodimer. In some aspects, the antimicrobial agent includes a sequence having at least 70% sequence identity to a sequence provided in SEQ ID NO: 40-4101. In some aspects, the antimicrobial agent includes a sequence having at least 75%, 76%, 77%, 78%, 79%, 80%, 81%, 82%, 83%, 84%, 85%, 86%, 87%, 88%, 890%, 90%, 91%, 92%, 93%, 94%, 95%, 96%, 97%, 98%, 99%, or 100% sequence identity to at least one sequence provided in SEQ ID NO: 40-4101. Preferably, the antimicrobial agent includes a sequence having at least 85% sequence identity to SEQ ID NO: 40.

In some aspects, the antimicrobial agent of the disclosure includes a linker sequence that operably connects the first synthetic amino acid sequence to the second synthetic amino acid sequence. Suitable linker sequences further enhance kinetics of antimicrobial activity of the antimicrobial agent. In some aspects, the linker sequence is tailored to enhance solubility in polar environments. In some aspects, the linker sequence is tailored to enhance solubility in lipophilic environments. In some aspects, the linker sequence is tailored to enhance chemical stability in a variety of chemical environments. Suitable linker sequences may be 3, 4, 5, 6, 7, 8, 9, 10, 11, 12, 13, 14, 15, 16, 17, 18, 19, 20, or more amino acids in length. Preferably, the linker sequence is about 5, 6, 7, 8, 9, or 10 amino acids in length. More preferably, the linker sequence is about 5 to 8 amino acids in length. Suitable linker sequence may include any amino acid in each position, so long as the antimicrobial activity of the antimicrobial agent is not disrupted. Such linker sequences include those that permit antiparallel alignment of two distinct helices formed by the first synthetic and second synthetic amino acid sequences. Such linker sequences also include those that enhance antimicrobial activity of the first synthetic and second synthetic amino acid sequences. By way of example, without limitation, the first amino acid position of the linker sequence may be productively occupied with an anionic residue such as aspartate or glutamate, which may enhance antimicrobial activity by stabilizing an active conformation. Also, by way of example, without limitation, the linker sequence may include 5 to 8 asparagine residues to enhance solubility in polar environments while not distrubing the active conformation incumbent in the remainder of the molecule. Alternatively, the linker sequence may include 5 to 8 glycine residues to enhance solubility in polar environments while not distrubing the active conformation incumbent in the remainder of the molecule. In other aspects, the linker sequence may be of a heterogeneous form, composed of about 5 to about 8 residues selected from the following amino acids, including, asparagine, glutamine, glycine, histidine, serine, threonine, and combinations thereof. Suitable heterogeneous formulations may be selected to enhance solubility in polar environments while not disturbing the active conformation incumbent in the remainder of the molecule.

In some aspects, the linker sequence is generally the sequence of formula 2: (A1-P2-P3- ... Pn), with "A" referring to an anionic residue, "P" referring to a polar residue, and "n" referring to an integer between about 3 and about 25. Suitable anionic residues include those known as such in the art, including, without limitation, aspartate and glutamate. Suitable polar residues include those known as such in the art, including, without limitation, glutamine, glycine, histidine, serine, and threonine. In some aspects, n is an integer such as that including, 3, 4, 5, 6, 7, 8, 9, 10, 11, 12, 13, 14, 15, 16, 17, 18, 19, 20, 21, 22, 23, 24, or 25. Preferably, n is an integer such as 5, 6, 7, 8, 9, 10, 11, 12, 13, 14, or 15. In some aspects, the linker sequence has at least 70% sequence identity to a sequence of formula 2. In some aspects, the amino acid sequence has at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence of formula 2. Preferably, the linker sequence has at least 85% sequence identity to a sequence of formula 2.

In some aspects, the linker sequence has at least 70% sequence identity to a sequence provided in SEQ ID NO: 34-39. In some aspects, the amino acid sequence has at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to at least one sequence provided in SEQ ID NO: 34-39. Preferably, the linker sequence has at least 85% sequence identity to at least one sequence provided in SEQ ID NO: 34-39.

The antimicrobial agents of the disclosure also include nucleic acid molecules encoding the amino acid sequences described herein, as well as expression vectors, encoding an antimicrobial agent, variant, or fragment thereof. Also, the disclosure provides isolated cells containing such nucleic acids, expression vectors, or peptides described herein. The disclosure provides compositions containing nucleic acid molecules or peptides of the disclosure, as well as variants or fragments thereof. Further, the disclosure provides articles of manufacture containing nucleic acid molecules or peptides of the disclosure, as well as variants or fragments thereof.

The disclosure provides antimicrobial agents having broad antimicrobial activity against microorganisms including bacteria, yeast, protozoa, fungi, mold, viruses, and combinations thereof. In some aspects, the antimicrobial agents have antimicrobial activity against Gram-positive and Gram-negative bacteria. The antimicrobial agents of the disclosure may be used to inhibit or prevent growth of a microorganism. Such microorganisms may include, without limitation, strains of *Pseudomonas, Escherichia, Staphylococcus, Streptococcus, Enterococcus, Mycobacteria, Haemophilus*, and combinations thereof.

In some aspects, the antimicrobial compositions may include a pharmaceutical carrier. In some aspects, the antimicrobial compositions may include a food additive.

The disclosure provides methods of reducing or inhibiting growth or survival of a microbe. Such methods include contacting the microbe with the antimicrobial agent.

In some aspects, the disclosure provides a method of reducing or inhibiting growth or survival of a microbe in a subject. The method includes contacting, or administering to, the subject a composition containing an antimicrobial agent. A therapeutically effective amount of the composition is delivered to the subject.

In some aspects, the disclosure provides a method of treating a microbial infection in a subject. The method includes contacting, or administering to, the subject a composition containing an antimicrobial agent disclosed herein. A therapeutically effective amount of the composition is delivered to the subject.

In some aspects, the disclosure provides a method of treating mastitis in a subject. The method includes identifying a subject having mastitis and contacting, or administering to, the subject a composition containing an antimicrobial agent. In some aspects, a therapeutically effective amount of the composition is administered directly to the mammary tissue of the subject.

The present disclosure further provides an article of manufacture, or kit, that includes a vessel and an antimicrobial agent. The article of manufacture may include packaging material that contains the antimicrobial agent and a label that indicates the antimicrobial agent can be used for treating mastitis. The article of manufacture may include packaging material that contains the antimicrobial agent and a label that indicates the antimicrobial agent can be used for treating a microbial infection in a subject. The article of manufacture may include packaging material that contains the antimicrobial agent and a label that indicates the antimicrobial agent can be used for inhibiting the growth or survival of microbes. The article of manufacture may include packaging material that contains the antimicrobial agent and a label that indicates the antimicrobial agent can be used for inhibiting the growth or survival of microbes in a subject.

BRIEF DESCRIPTION OF THE DRAWINGS

The following drawings form part of the present specification and are included to further demonstrate certain aspects of the disclosure. The disclosure may be better understood by reference to one or more of these drawings in combination with the detailed description of specific embodiments presented herein.

The patent or application file contains at least one drawing executed in color. Copies of this patent or patent application publication with color drawings will be provided by the Office upon request and payment of the necessary fee.

DETAILED DESCRIPTION

Figure 1:
FIG. 1 graphically illustrates the amino acid composition of some antimicrobial agent aspects. Residue colors reflect a preference for lipophilic (yellow) or basic (blue).
Figure 2:
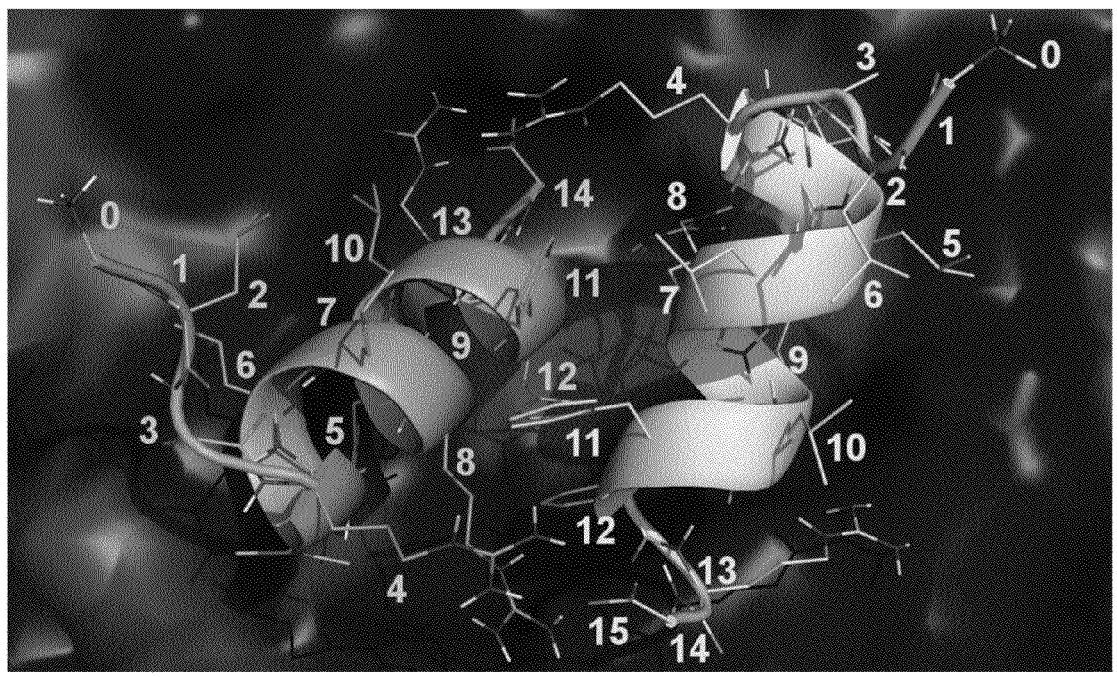
FIG. 2 shows the antimicrobially active dimer structure based on molecular dynamics simulations. Green and yellow objects are two compositionally identical peptides oriented in antiparallel alignment. Numbers identify the specific amino acid positions including the amino terminus (position 0) and the carboxy terminus (position 15). The solid surface represents the lipid membrane colored according to neutral (blue) or anionic (red) lipid.

In accordance with the present disclosure, compositions and methods of using antimicrobial agents to inhibit the growth or survival of microorganisms have been discovered. In particular, antimicrobial agents having peptides with antimicrobial activity are used to inhibit the growth or survival of microorganisms. Therefore, the compositions and methods described herein are useful for antimicrobial treatments and therapeutics. Furthermore, the compositions and methods described herein may be used where antimicrobial resistance has reduced the availability of antimicrobial treatments or therapeutics.

I. Compositions

The compositions of the disclosure include antimicrobial agents having antimicrobial activity against at least one microorganism. In some aspects, the compositions of the disclosure include antimicrobial agents having antimicrobial activity against more than one microorganism.

a. Nucleic Acids Encoding Antimicrobial Agents

The disclosure provides antimicrobial agents that include synthetic peptides having antimicrobial activity. In some aspects the antimicrobial agents include peptides, a fragment thereof, or a variant thereof, as well as nucleic acid molecules that encode the synthetic peptide of the disclosure. Such nucleic acid molecules may include an expression vector.

Nucleic acids encoding antimicrobial peptides derived from water buffalo host defense proteins are disclosed. The nucleic acid sequences encoding antimicrobial peptides of the disclosure were derived from SEQ ID NO: 1 and the encoded amino acid sequence of SEQ ID NO: 2, having the antimicrobial peptide sequence of SEQ ID NO: 3. Suitable nucleotide sequences of the present disclosure include those that encode a peptide having antibacterial activity such as those peptides provided by SEQ ID NOs: 3-33, 40-4101, and those described herein.

Mutant nucleotides of the antimicrobial peptides may be used, so long as mutants include nucleic acid sequences that encode functional antimicrobial peptides as described herein. The subject nucleic acids may be mutated to alter properties of the encoded peptide such as expression properties, folding properties, solubility properties, and antibacterial activity. A skilled artisan will recognize that proteins encoded by nucleic acids encoding homologues or mutants may have the same antibacterial properties as the peptides of SEQ ID NOs: 3-33 and 40-4101, or may have altered antibacterial properties. The DNA sequence or protein product of such a mutation will usually be substantially similar to the sequences provided herein and will differ by one or more nucleotides or amino acids. The sequence changes may be substitutions, insertions, deletions, or a combination thereof. Techniques for mutagenesis of cloned genes are known in the art. Methods for site specific mutagenesis may be found in Gustin et al., Biotechniques 14:22, 1993; Barany, Gene 37:111-23, 1985; Colicelli et al., Mol. Gen. Genet. 199:537-9, 1985; and Sambrook et al., Molecular Cloning: A Laboratory Manual, CSH Press 1989, pp. 15.3-15.108 and all incorporated herein by reference. Such mutated nucleic acid derivatives may be used to study structure-function relationships of a particular antimicrobial peptide, or to alter properties of the peptide that affect its function or regulation. In summary, the disclosure relates to antimicrobial peptide coding sequences such as those that encode amino acid sequences of SEQ ID NOs: 3-33, 40-4101, and variants or mutants thereof. Also, the disclosure encompasses the intermediary RNAs encoded by the described nucleic acid sequences and that translates into an antimicrobial peptide of the disclosure.

b. Antimicrobial Peptide Compositions

A synthetic peptide disclosed herein may be obtained using methods known in the art, including isolation from a cell expressing the peptide, chemical synthesis, or the peptide may be expressed from a recombinant nucleic acid molecule. Methods of synthesizing a subject peptide are described in Current Protocols in Protein Science, Units 5, pub. John Wiley & Sons, Inc., 2002 and Current Protocols in Protein Science, Units 6, pub. John Wiley & Sons, Inc., 2002 and both are incorporated herein by reference.

The disclosure contemplates antimicrobial peptides and mutants thereof, which include those peptides encoded by the subject nucleic acids. The synthetic antibacterial peptides, or agents, disclosed herein are exemplified by the sequences of SEQ ID NOs: 3-33 and 40-4101. Further, the disclosure includes both homodimers and heterodimers of the antibacterial peptides described herein.

Homologs or peptides that vary in sequence from the amino acid sequences SEQ ID NOs: 3-33 and 40-4101 are also included in the disclosure. By homolog is meant a protein having at least about 10%, usually at least about 25%, 30%, 40%, 45%, 50%, 55%, 60%, 65%, 70%, 75%, 80%, 85%, 90%, 95%, 99% or higher amino acid sequence identity to the proteins encoded by SEQ ID NOs: 3-33 or 40-4101, as determined using MegAlign, DNAstar (1998) clustal algorithm as described in Higgins, D. G. and Sharp, P. M., Fast and Sensitive Multiple Sequence Alignments on a Microcomputer, CABIOS, 5: 151-153, 1989, both incorporated herein by reference.

Antimicrobial peptides disclosed herein may be mutated, or altered, to enhance, or change, biological properties of the protein. Such biological properties include, but are not limited to, in vivo or in vitro stability (e.g., half-life), solubility, amphiphilicity and various aspects of antimicrobial activity. Such antimicrobial activity aspects include, without limitation, tissue specificity, microbial target selectivity, broad spectrum antimicrobial potency and invariance as a function of microbial resistance mechanisms. Suitable mutations include single amino acid changes, deletions of one or more amino acids, N-terminal truncations, C-terminal truncations, insertions, etc. Mutants can be generated using standard techniques of molecular biology, including random mutagenesis and targeted mutagenesis as described in Current Protocols in Molecular Biology, Unit 8, pub, John Wiley & Sons, Inc., 2000 and incorporated herein by reference.

The manifold of currently considered peptide formulations is of substantial value because the manifold as a whole has a mechanism of action that is not susceptible to a key microbial antioxidative resistance mechanism conferred by membrane expression of staphyloxanthin. Furthermore, strategic sequence variation within the manifold may be applied to counteract microbial defenses effected by adaptive membrane charge distribution corresponding to covalent modification of anionic lipids, or greater membrane staphyloxanthin expression.

The antimicrobial peptides disclosed herein are characterized by having antimicrobial activity. Specifically, the peptides disclosed are capable of disrupting the cell membrane of microorganisms, leading to the microorganism's destruction.

The antimicrobial peptides generally have a first synthetic amino acid sequence of formula 1 (Gly-$X_1$-$X_2$-$X_3$-$X_1$-$X_1$-$X_1$-Arg-$X_4$-$X_1$-$X_5$-$X_6$-$X_6$-Gly) where $X_1$ is selected from the group of Leu or Ile; $X_2$ is selected from the group of Ala, Val, Leu, Ile, or Pro; $X_3$ is selected from the group of Arg or Trp; $X_4$ is selected from the group of Trp, Ile, or Leu; $X_5$ is selected from the group of Phe or Trp; and, $X_6$ is selected from the group of Phe, Trp, or Arg.

The antimicrobial peptides also may have a second antimicrobial synthetic amino acid sequence of formula 1 (Gly-$X_1$-$X_2$-$X_3$-$X_1$-$X_1$-$X_1$-Arg-$X_4$-$X_1$-$X_5$-$X_6$-$X_6$-Gly) where $X_1$ is selected from the group of Leu or Ile; $X_2$ is selected from the group of Ala, Val, Leu, Ile, or Pro; $X_3$ is selected from the group of Arg or Trp; $X_4$ is selected from the group of Trp, Ile, or Leu; $X_5$ is selected from the group of Phe or Trp; and, $X_6$ is selected from the group of Phe, Trp, or Arg. The antimicrobial agent may include a homodimer of antimicrobial peptides, where a first antimicrobial synthetic sequence has the same sequence as a second antimicrobial synthetic sequence. The antimicrobial agent may include a heterodimer of antimicrobial peptides, where a first antimicrobial synthetic sequence has a different sequence as a second antimicrobial synthetic sequence. Such difference may be by one or more amino acid sequences.

The antimicrobial peptides typically range in length from about 14 amino acid residues to about 30 amino acid residues. In some aspects, the antimicrobial peptides are about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 or more amino acid residues in length. Preferably, the antimicrobial peptides are 14 amino acid residues in length. In some aspects, antimicrobial agents including homodimers of the antimicrobial peptides are about 28 amino acid residues in length. In some aspects, antimicrobial agents including homodimers of the antimicrobial peptides are about 35 amino acid residues in length. In some aspects, antimicrobial agents including heterodimers of the antimicrobial peptides are about 28 amino acid residues in length. In some aspects, antimicrobial agents including heterodimers of the antimicrobial peptides are about 35 amino acid residues in length. A skilled artisan will recognize that the length of a homodimer or heterodimer of the antimicrobial peptides depends upon the length of the antimicrobial peptide used in the respective homodimer or heterodimer.

The antimicrobial agent may include a linker sequence to connect a first antimicrobial synthetic sequence to a second antimicrobial synthetic sequence. In some aspects, the linker sequence connected to a first and second antimicrobial peptide produces a covalently linked dimer formulation. Suitable linker sequences may be used to improve antimicrobial kinetics. In one aspect, the linker sequence enhances kinetics by encouraging the dimerized structure to remain in a conformation conducive to antimicrobial activity. In one aspect, the linker sequence may be used to enhance delivery of the dimer. Such linker sequences may include specific amino acid formulations that favor solubility in polar or lipophilic media. In another aspect, the linker sequence may be used to enhance chemical stability within different environments.

Suitable linker sequences may be tailored to provide specific enhancements. A linker sequence may be a length of any size that does not disrupt the antimicrobial activity of the antimicrobial peptide. In some aspects, the linker sequence may be a length of about 2, 3, 4, 5, 6, 7, 8, 9, 10, 11, 12, 13, 14, 15, 16, 17, 18, 19, 20, 25, 30, 35, 40, 45, 50 or more amino acid residues. Preferably, the linker sequence is a length of about 2, 3, 4, 5, 6, 7, 8, 9, or 10 amino acid residues. In some aspects, the linker sequence is a length of about 7 amino acid residues. The amino acid residues of the linker sequence may be tailored to provide specific enhancements. In some aspects, the linker sequence includes mostly polar amino acids. In some aspects, the linker sequence includes at least one sequence of SEQ ID NO: 34-39. In some aspects, the linker sequence includes the sequence of SEQ ID NO: 34.

c. Pharmaceutical Compositions

The present disclosure provides a pharmaceutical composition including at least one antimicrobial agent described herein. To prepare such a pharmaceutical composition, an antimicrobial agent, an antimicrobial peptide, homodimer, heterodimer, or combinations thereof is synthesized or otherwise obtained, purified as necessary or desired and then lyophilized and stabilized. The antimicrobial agent may then be adjusted to the appropriate concentration and combined with other agents or pharmaceutically acceptable carriers. Suitable pharmaceutically acceptable carriers include, without limitation, a carrier, diluent, excipient, salt, or combinations thereof, that are compatible with the other ingredients of the formulation and not deleterious to the recipient thereof.

Pharmaceutical formulations containing an antimicrobial agent disclosed herein may be prepared by procedures known in the art using well-known and readily available ingredients. For example, the antimicrobial agent may be formulated with common excipients, diluents, or carriers, and formed into tablets, capsules, solutions, suspensions, powders, aerosols and the like. Examples of excipients, diluents, and carriers that are suitable for such formulations include buffers, as well as fillers and extenders such as starch, cellulose, sugars, mannitol, and silicic derivatives. Binding agents may also be included such as carboxymethyl cellulose, hydroxymethylcellulose, hydroxypropyl methylcellulose and other cellulose derivatives, alginates, gelatin, and polyvinyl-pyrrolidone.

II. Methods

The compositions of the present disclosure including at least one antimicrobial agent are useful in methods of reducing the growth or survival of microorganisms. A skilled artisan will appreciate the numerous methods of using the antimicrobial agents disclosed herein. Accordingly, the methods included herein are examples and are not limiting of the scope by which the antimicrobial agents may be used. The methods of the disclosure include reducing the growth or survival of microorganisms, treating a subject having a microorganism infection, and treating a subject having mastitis, as well as other methods using the antimicrobial agents disclosed herein.

Microorganisms against which an antimicrobial agent disclosed herein is active include Gram-negative bacteria, Gram-positive bacteria, yeast, fungi, mold, viruses, unicellular parasites, and other microorganisms known in the art.

Non-limiting examples include Staphylococcus aureus, Listeria monocytogenes, Escherichia coli, Klebsiella pneumoniae, Salmonella typhimurium, Pseudomonas aeruginosa, Proteus mirabilis, Salmonella enteritidis, Neisseria gonorrhoeae, Ureaplasma canigenitalium, Ureaplasma urealyticum, Candida albicans, Trichomonas vaginalis, Treponema pallidum, Chlamydia trachomatis, Staphylococcus hyicus, Coagulase negative staphylococci, Streptococcus agalactiae, Streptococcus hyicus, Streptococcus epidermidis, Streptococcus xylosus, Streptococcus intermedius. Streptococcus dysgalactiae, Streptococcus uberis, Mycoplasma spp. (Mycoplasma bovis, Mycoplasma bovigenitalium, Mycoplasma canadense, Mycoplasma californicum, Mycoplasma alkalescens), Escherichia coli, Klebsiella spp. (Klebsiella pneumoniae, Klebsiella oxytoca), Enterobacter spp. (E. aerogenes, E. amnigenus, E. agglomerans, E. arachidis, E. asburiae, E. cancerogenous, E. cloacae, E. cowanii, E. dissolvens, E. gergoviae, E. helveticus, E. hormaechei, E. intermedius, E. kobei, E. ludwigii, E. mori, E. nimipressuralis, E. oryzae, E. pulveris, E. pyrinus, E. radicincitans, E. taylorae, E. turicensis, E. sakazakii, Enterobacter soli), Citrobacter spp (C. amalonaticus, C. braakii, C. diversus, C. farmeri, C. freundii, C. gillenii, C. koseri, C. murliniae, C. rodentium, C. sedlakii, C. werkmanii, C. youngae), Proteus spp. (P. hauseri, P. mirabilis, P. myxofaciens, P. penneri, P. vulgaris), Enterococci, Serratia spp., Pseudomonas spp. (P. aeruginosa, P. alcaligenes, P. anguilliseptica, P. argentinensis, P. borbori, P. citronellolis, P. flavescens, P. mendocina, P. nitroreducens, P. oleovorans, P. pseudoalcaligenes, P. resinovorans, P. straminea), P. chlororaphis group (P. agarici, P. asplenii, P. aurantiaca, P. aureofaciens, P. chlororaphis, P. corrugata, P. fragi, P. lundensis, P. taetrolens), P. fluorescens group (P. antarctica, P. azotoformans, P. brassicacearum, P. brenneri, P. cedrina, P. corrugata, P. fluorescens, P. gessardii, P. libanensis, P. mandelii, P. marginalis, P. mediterranea, P. meridiana, P. migulae, P. mucidolens, P. orientalis, P. panacis, P. protegens, P. proteolytica, P. rhodesiae, P. synxantha, P. thivervalensis, P. tolaasii, P. veronii), P. pertucinogena group (P. denitrificans, P. pertucinogena), P. putida group (P. cremoricolorata, P. fulva, P. monteilii, P. mosselii, P. oryzihabitans, P. parafulva, P. plecoglossicida, P. putida), P. stutzeri group (P. balearica P. luteola, P. stutzeri), P. syringae group (P. amygdali, P. avellanae, P. caricapapayae, P. cichorii, P. coronafaciens, P. ficuserectae, P. meliae, P. savastanoi, P. syringae, P. viridiflava), incertae sedis (P. abietaniphila, P. acidophila, P. agarici, P. alcaliphila, P. alkanolytica, P. amyloderamosa, P. asplenii, P. azotifigens, P. cannabina, P. coenobios, P. congelans, P. costantinii, P. cruciviae, P. delhiensis, P. excibis, P. extremorientalis, P. frederiksbergensis, P. fuscovaginae, P. gelidicola, P. grimontii, P. indica, P. jessenii, P. jinjuensis, P. kilonensis, P. knackmussii, P. koreensis, P. lini, P. lutea, P. moraviensis, P. otitidis, P. pachastrellae, P. palleroniana, P. papaveris, P. peli, P. perolens, P. poae, P. pohangensis, P. protegens, P. psychrophila, P. psychrotolerans, P. rathonis, P. reptilivora, P. resiniphila, P. rhizosphaerae, P. rubescens, P. salomonii, P. segitis, P. septica, P. simiae, P. suis, P. thermotolerans, P. tremae, P. trivialis, P. turbinellae, P. tuticorinensis, P. umsongensis, P. vancouverensis, P. vranovensis, P. xanthomarina), Prototheca, Corynebacterium bovis, Arcanobacterium pyogenes, Bacillus spp. (B. alcalophilus, B. alvei, B. aminovorans, B. amyloliquefaciens, B. aneurinolyticus, B. anthracis, B. aquaemaris, B. atrophaeus, B. azotoformans, B. badius, B. boroniphilus, B. brevis, B. caldolyticus, B. centrosporus, B. cereus, B. circulans, B. coagulans, B. fastidious, B. firmus, B. flavothermus, B. fusiformis, B. gallicensis, B. globigii, B. globisporus, B. infernus, B. insolitus, B. larvae, B. laterosporus, B. lentimorbus, B. lentus, B. licheniformis, B. macerans, B. macquariensis, B. marinus, B. megaterium, B. mesentericus, B. mucilaginosus, B. mycoides, B. natto, B. pantothenticus, B. pasteurii, B. polymyxa, B. popilliae, B. pseudoanthracis, B. pumilus, B. schlegeliiB. sphaericus, B. sporothermodurans, B. stearothermophilus, B. subtilis, B. thuringiensis, B. vulgatis, B. weihenstephanensis), Pasteurella spp. (P. aerogenes, P. anatis, P. avium, P. bettyae, P. caballi, P. canis, P. dagmatis, P. gallicida, P. gallinarum, P. granulomatis, P. langaaensis, P. lymphangitidis, P. mairii, P. multocida, P. oralis, P. pneumotropica, P. skyensis, P. stomatis, P. testudinis, P. trehalosi, P. ureae, P. volantium), Serratia spp. (S. entomophila, S. ficaria, S. fonticola, S. grimesii, S. liquefaciens, S. marcescens, S. odorifera, S. plymuthica, S. proteamaculans, S. quinivorans, S. rubidaea, S. symbiotica), and other microorganisms known in the art. Such unicellular parasites include, without limitation, leishmania, treponema, giardia, and others known in the art.

In some aspects, microorganisms against which an antimicrobial agent disclosed herein is active may also include medically relevant bacteria. Such medically relevant bacteria may include, without limitation, Staphylococcus aureus, S. epidermidis, S. haemolyticus, S. intermedius, S. lugdunensis, S. saprophiticus, S. schleiferi, S. warneri; Streptococcus agalactiae, S. anginosus, S. bovis, S. equisimilis, S. mitis, S. mutans, S. pneumonia, S. pyogenes, S. sanguis, S. salivarius, S. suis; Enterococcus faecalis, E. faecium; Neisseria gonorrhoeae, N. meningitides; Moraxella catarrhalis, M. lacunata, M. nonliquefaciens, M. urethralis; Kingella kingae, K. denitrificans; Eikenella corrodens; Bacillus alvei, B. anthracis, B. brevis, B. cereus, B. circulans, B. coagulans, B. licheniformis, B. macerans, B. pumilus, B. sphaericus, B. subtilis, B. thuringiensis; Clostridium botulinum, C. bifermentans, C. butyricum, C. camis, C. clostridioforme, C. difficile, C. fallax, C. histolyticum, C. innocuum, C. perfringens, C. novyi, C. ramosum, C. septicum, C. sordellii, C. tertium, C. tetani; Listeria monocytogenes; Erysipelothrix rhusiopathiae; Propionibacterium acnes, Streptobacillus moniliformis; Calymmatobacterium granulomatis; Bacteroides distasonis, B. fragilis, B. thetaiotaomicron, B. ovatus, B. vulgatus; Fusobacterium mortiferum, F. nucleatum, F. necrophorum; Gemella morbillorum; Peptostreptococcus (P. anaerobius, P. asaccharolyticus, P. hydrogenalis, P. magnus, P. melaninogenica, P. micros, P. tetradius, P. prevotii,); Porphyromonas (P. asaccharolytica, P. gingivalis); Prevotella (P. melaninogenica, P. oris, P. buccae); Veillonella parvula; Salmonella choleraesuis, S. enteritidis, S. gastroenteritis, S. paratyphi-A, S. schottmuelleri, S. typhi, S. typhimurium; Shigella boydii, S. dysenteriae, S. flexneri, S. sonnei; Arcobacter cryaerophilia, A. butzleri, A. skirrowii; Campylobacter coli, C. fetus, C. hyointestinalis, C. jejuni, C. lari, C. sputorum, C. upsaliensis; Helicobacter pylori, H. cinaedi, H. fennelliae; Vibrio cholera, V. damsela, V. fetus, V. fluvialis, V. furnissia, V. hollisae, V. mimicus, V. parahaemolyticus, V. vulnificus; Citrobacter freundii, C. diversus (C. koseri); Escherichia coli; Enterobacter aerogenes, E. cloacae; Klebsiella pneumoniae, K. rhinoscleromatis, K. ozaenae; Proteus mirabilis; Serratia marcescens; Pseudomonas aeruginosa, P. cepacia, P. fluorescens, P. maltophilia, P. mallei, P. pseudomallei, P. putida, P. putrefaciens, P. stutzeri; Brucella abortus, B. canis, B. melitensis, B. suis; Pasteurella haemolytica, P. multicida; Yersinia enterocolitica, Y. pestis, Y. pseudotuberculosis; Francisella tularensis; Haemophilus influenza, H. parainfluenzae, H. ducreyi, H. aegyptius; Bordetella avium, B. bronchiseptica, B. hinzii, B. parapertussis, B. pertussis; Corynebacterium diphtheria, C. kutscheri, C. pseudotuberculosis, C. pseudodiphtheriticum, C. renale, C. xerosis, C. ulcerans; Mycobacterium africanum, M. avium-intracellulare, M. bovis, M. fortuitum, M. kansasii,

*M. leprae, M. marinum, M. microtii, M. tuberculosis, M. scrofulaceum, M. ulcerans; Nocardia asteroides, N. brasiliensis, N. caviae; Actinomyces bernardiae, A. bovis, A. denticolens, A. gerencseriae, A. georgiae, A. hordeovulneris, A. howellii, A. hyovaginalis, A. israelii, A. meyeri, A. naeslundii, A. neuii, A. odontolyticus, A. pyogenes, A. radingae, A. slackii, A. suis, A. turicensis, A. viscosus; Propionibacterium propionicus; Streptomyces somaliensis; Leptospira interrogans, L. biflexa, Borrelia burgdorferi; B. hermsii, B. recurrentis, B. turicatae; Spirillum minum; Treponema pallidum, T. carateum; Mycoplasma fermentans, M. genitalium, M. hominis, M. penetrans, M. pirum, M. pneumonia; Ureaplasma urealyticum; Rickettsiae akari, R. australis, R. conorii, R. japonica, R. prowazekii, R. rickettsii, R. sibirica, R. typhi; Ehrlichia canis, E. chaffeensis, E. equi, E. ewingii, E. phagocytophila, E. platys, E. risticii, E. sennetsu; Orientia tsutsugamushi; Coxiella burnetii; Bartonella bacilliformis; B. henselae, B. Quintana; Chlamydia pneumonia, C. psittaci, C. trachomatis; Legionella ansia, L. dumollii, L. feelei, L. micdadei, L. pneumophila*, and other medically relevant bacteria known in the art or yet to be discovered.

In some aspects, microorganisms against which an antimicrobial agent disclosed herein is active may also include veterinary relevant bacteria. Such relevant bacteria may include, without limitation, *Acholeplasma laidlawii; Acinetobacter Iwoffii; Actinobacillus equuli, A. lignieresii, A. pleuropneumoniae, A. rossi, A. suis; Actinobaculum suis; Actinomyces bovis, A. viscosus; Aeromonas hydrophila, A. salmonicida; Aliivibrio salmonicida; Anaplasma phagocytophilum; Arcobacter butzleri; Avibacterium paragallinarum; Bacillus anthracis, B. cereus, B. licheniformis, B. subtilis, B. thuringiensis; Bacteroides fragilis; Bartonella clarridgeiae, B. elizabethae, B. henselae, B. vinsonii; Bibersteinia trehalosi; B. avium, B. bronchiseptica, B. parapertussis, B. pertussis; Borrelia afzelii, B. anserine, B. burgdorferi, B. garinii; Brachyspira aalborgi, B. alvinipulli, B. hyodysenteriae, B. intermedia, B. pilosicoli, B. suanatina; Brochothrix thermosphacta; Brucella abortus, B. canis, B. ceti, B. melitensis, B. ovis, B. pinnipedialis, B. suis; Burkholderia mallei, B. pseudomallei; Campylobacter coli, C. fetus, C. jejuni, C. lad, C. upsaliensis; Chlamydia trachomatis; Chlamydophila abortus, C. felis, C. psittaci; Citrobacter freundii; Clostridium botulinum*, group I, II, III, IV; *Clostridium chauvoei, C. difficile, C. haemolyticum, C. novyi, C. perfringens, C. piliforme, C. septicum, C. sordellii, C. tetani; Corynebacterium bovis, C. diphtheria, C. kutscheri, C. pseudotuberculosis, C. renale, C. ulcerans; Coxiella burnetii; Dermatophilus congolensis; Dichelobacter nodosus; Edwardsiella ictaluri, E. tarda; Ehrlichia canis, E. ruminantium; Enterococcus faecalis, E. faecium; Erysipelothrix rhusiopathiae; Escherichia coli; Flavobacterium columnare, F. psychrophilum; Francisella noatunensis, F. tularensis; Fusobacterium canifelinum, F. equinum, F. necrophorum; Gallibacterium anatis; Haemophilus parasuis; Helicobacter hepaticus, H. pylori; Histophilus somni; Klebsiella oxytoca, K. pneumoniae; Lactobacillus plantarum; Lawsonia intracellularis; Legionella pneumophila; Leptospira borgpetersenii, L. interrogans, L. kirschneri; Listeria innocu, L. ivanovii, L. monocytogenes; Listonella anguillarum; Mannheimia granulomatis, M. haemolytica, M. varigen; Melissococcus plutonius; Microcystis aeruginosa; Moraxella bovis, M. osloensis; Morganella morganii; Mycobacterium avium, M. bovis, M. leprae, M. marinum, M. tuberculosis; Mycoplasma agalactiae, M. bovis, M. capricolum, M. felis, M. gallisepticu, M. haemofelis, M. hyopneumoniae, M. hyorhinis, M. hyosynoviae, M. meleagridi, M. mycoides, M. pneumonia, M. pulmonis, M. suis, M. synoviae; Neisseria gonorrhoeae; Neorickettsia risticii; Nicoletella semolina; Nocardia asteroids; Paenibacillus larvae; Pasteurella caballi, P. dagmatis, P. multocida, P. pneumotropica; Peptoniphilus indolicus; Plesiomonas shigelloides; Prevotella melaninogenica; Proteus mirabilis, P. vulgaris; Pseudomonas aeruginosa, P. anguilliseptica; Renibacterium salmoninarum; Rhodococcus equi; Rickettsia prowazekii, R. rickettsia; Riemerella anatipestifer; Salmonella spp., S. enterica; Serratia marcescens; Shigella dysenteriae, S. flexneri; Staphylococcus aureus, S. epidermidis, S. felis, S. hyicus, S. intermedius, S. pseudintermedius, S. schleiferi; Stenotrophomonas maltophilia; Streptobacillus moniliformis; Streptococcus agalactiae; S. canis, S. devriesei, S. dysgalactiae, S. equi, S. pneumonia, S. porcinus, S. pyogenes, S. suis, S. uberis; Taylorella asinigenitalis, T. equigenitalis; Treponema pallidum, T. paraluiscuniculi, T. pedis, T. phagedenis; Trueperella pyogenes; Ureaplasma diversum; Vibrio alginolyticus, V. cholera, V. parahaemolyticus, V. vulnificus; Yersinia enterocolitica, Y. pestis, Y. pseudotuberculosis, Y. ruckeri* and other veterinary relevant bacteria known in the art or yet to be discovered.

The method of reducing the growth or survival of microorganisms includes contacting a microorganism population with an antimicrobial agent of the present disclosure. The method may include first identifying a microorganism population.

The methods disclosed herein include methods of inhibiting the survival or growth of a microorganism. The term "inhibit" includes a decrease in any detectable amount, for example, 5%, 10%, 20%, 30%, 40%, 50%, 60%, 70%, 80%, 90% or more, and can be determined by methods known in the art. Exemplary methods of detecting inhibition includes a determination by count, such as a bacterial culture or viral titer, or by evaluation of one or more symptoms associated with infection by a microorganism. Symptoms associated with infection by a microorganism are known in the art. Such symptoms are characteristic to a particular infectious microorganism and the resulting condition.

A composition that can support growth or survival of a microorganism may be contacted with an effective amount of the antimicrobial agent in a variety of ways. For example, if the composition is a food item, the antimicrobial agent may be added directly to the food, it may be incorporated into the matrix of the packaging material or it may be coated onto the packaging material, in which case the antimicrobial agent may be released during storage, upon dissolution of the encapsulation material, contact with moisture or at a predetermined temperature. If the composition is a body fluid, the antimicrobial agent may be added directly to the body fluid.

A subject may be contacted with the antimicrobial agent in a variety of ways including, without limitation, administration using routes commonly known in the art. Such routes include oral, parenteral (including subcutaneous, intravenous, intramuscular and intraperitoneal), rectal, vaginal, dermal, transdermal (topical), transmucosal, intrathoracic, intrapulmonary and intranasal (respiratory) routes. The means of administration may be by injection, using a pump or any other appropriate mechanism.

An antimicrobial agent disclosed herein may be administered to a subject in a single does, in multiple doses, in a continuous or intermittent manner, depending, for example, upon the recipient's physiological condition, whether the purpose of the administration is therapeutic or prophylactic, and other factors known to skilled artisans. The administration of the antimicrobial agents may be essentially continuous over a pre-selected period of time or may be in a series of spaced doses. Both local and systemic administration is contemplated.

The dosage to be administered to a subject may be any amount appropriate to reduce or prevent infection or to treat at least one symptom associated with the infection. Some factors that determine appropriate dosages are well known to those skilled in the art and may be addressed with routine experimentation. For example, determination of the physico-chemical, toxicological and pharmacokinetic properties may be made using standard chemical and biological assays and through the use of mathematical modeling techniques known in the chemical, pharmacological and toxicological arts. The therapeutic utility and dosing regimen may be extrapolated from the results of such techniques and through the use of appropriate pharmacokinetic and pharmacodynamic models. Other factors will depend on individual patient parameters including age, physical condition, size, weight, the condition being treated, the severity of the condition, and any concurrent treatment. The dosage will also depend on the agent chosen and whether prevention or treatment is to be achieved, and if the agent is chemically modified.

The precise amount to be administered to a subject will be the responsibility of the attending physician. However, to achieve the desired effects, an antimicrobial agent disclosed herein may be administered as single or divided dosages. For example, of at least about 0.01 mg/kg to about 500 to 750 mg/kg, of at least about 0.01 mg/kg to about 300 to 500 mg/kg, at least about 0.1 mg/kg to about 100 to 300 mg/kg or at least about 1 mg/kg to about 50 to 100 mg/kg of body weight, although other dosages may provide beneficial results.

The absolute weight of a given antimicrobial agent disclosed herein included in a unit dose may vary widely. For example, about 0.01 to about 2 g, or about 0.1 to about 500 mg, of at least one antimicrobial agent may be administered. Alternatively, the unit dosage may vary from about 0.01 g to about 50 g, from about 0.01 g to about 35 g, from about 0.1 g to about 25 g, from about 0.5 g to about 12 g, from about 0.5 g to about 8 g, from about 0.5 g to about 4 g, or from about 0.5 g to about 2 g.

Daily doses of the antimicrobial agents may vary as well. Such daily doses may range, for example, from about 0.1 g/day to about 50 g/day, from about 0.01 g/day to about 25 g/day, from about 0.1 g/day to about 12 g/day, from about 0.5 g/day to about 8 g/day, from about 0.5 g/day to about 4 g/day, and from about 0.5 g/day to about 2 g/day.

An antimicrobial agent may be used alone or in combination with a second medicament. The second medicament may be a known antimicrobial agent such as, but not limited to, a β-lactam, macrolide or other antibiotics, e.g. Azithromycin, Doxycycline, Tetracycline, and Erythromycin; an antifungal agent such as clotrimazole, nystatin, fluconazole, ketoconazole, amphotericin B, caspofungin, or voriconazole; an agent effective against a protozoan such as, for example, Metronidazole or timidazole. The second medicament may also be an antiviral agent such as Abacavir, Acyclovir, Amantadine, Didanosine, Emtricitabine, Enfuvirtide, Entecavir, Ganciclovir, Gardasil, Lamivudine, Nevirapine, Nelfinavir, Oseltamivir, Ribavirin, Rimantadine, Ritonavir, Stavudine, Valaciclovir, Vidarabine, Zalcitabine, and Zidovudine. The effective amount of the second medicament will follow the recommendations of the second medicament manufacturer, the judgment of the attending physician and will be guided by protocols and administrative factors for amounts and dosing as indicated in the PHYSICIAN'S DESK REFERENCE (as commonly known in the art).

The effectiveness of the method of treatment may be assessed by monitoring the subject for signs or symptoms of the microbial infection as discussed above, as well as determining the presence or amount of microorganism present in the subject by methods known in the art.

III. Kits

The present disclosure provides articles of manufacture and kits containing materials useful for treating the conditions described herein. The article of manufacture may include a container of a composition as described herein with a label. Suitable containers include, for example, bottles, vials, and test tubes. The containers may be formed from a variety of materials such as glass or plastic. The container holds a composition having an antimicrobial agent disclosed herein, which is effective for inhibiting the growth of a microorganism or treating a condition caused by a microorganism. The label on the container may indicate that the composition is useful for treating specific conditions and may also indicate directions for administration.

DEFINITIONS

Unless defined otherwise, all technical and scientific terms used herein have the same meaning as is commonly understood by one of ordinary skill in the art. All patents, applications, published applications and other publications are incorporated by reference in their entirety. In the event that there is a plurality of definitions for a term herein, those in this section prevail unless stated otherwise.

As used herein, "administering" is used in its broadest sense to mean contacting a subject with a composition disclosed herein.

As used herein, the term "antimicrobial activity" means microbicidal or microbiostatic activity or a combination thereof, against one or more microorganisms. Microbicidal activity refers to the ability to kill or cause irreversible damage to a target microorganism. Microbiostatic activity refers to the ability to inhibit the growth or proliferative ability of a target microorganism without necessarily killing or irreversibly damaging it.

As used herein, the term "identity" or "sequence identity" refers to a relationship between two or more polypeptide sequences, as well as two or more polynucleotide sequences, namely a reference sequence and a given sequence to be compared with the reference sequence. Sequence identity is determined by comparing the given sequence to the reference sequence after the sequences have been optimally aligned to produce the highest degree of sequence similarity, as determined by the match between strings of such sequences. Upon such alignment, sequence identity is ascertained on a position-by-position basis. For example, the sequences are "identical" at a particular position if at that position, the nucleotides or amino acid residues are identical. The total number of such position identities is then divided by the total number of nucleotides or residues in the reference sequence to give percent (%) sequence identity. Sequence identity can be readily calculated by known methods, including but not limited to, those described in Computational Molecular Biology, Lesk, A. N., et., Oxford University Press, New York (1988), Biocomputing: Informatics and Genome Projects, Smith, D. W., ed., Academic Press, New York (1993); Computer Analysis of Sequence Data, Part I, Griffin, A. M., and Griffin, H. G., eds., Humana Press, New Jersey (1994); Sequence Analysis in Molecular Biology, von Heinge, G., Academic Press (1987); Sequence Analysis Primer, Gribskov, M. and Devereux, J., eds., M. Stockton Press, New York (1991); and Carillo et al., Applied Math., 48:1073 (1988), the teachings of which are incorporated herein by reference.

As used herein, the term "inhibit" means a decrease in any amount including, without limitation, a 5%, 10%, 15%, 20%, 25%, 30%, 35%, 40%, 45%, 50%, 55%, 60%, 65%, 70%, 75%, 80%, 85%, 90%, 95%, 100%.

The term "nucleic acid" is used herein to refer to a polymer of deoxynucleic ribose nucleic acids, as well as ribose nucleic acids. The term includes linear molecules, as well as covalently closed circular molecules. It includes single stranded molecules, as well as double stranded molecules.

As used herein, "subject" refers to a living organism having a central nervous system. In particular, subjects include, but are not limited to, human subjects or patients and companion animals. Exemplary companion animals may include domesticated mammals (e.g., dogs, cats, horses), mammals with significant commercial value (e.g., dairy cows, beef cattle, sporting animals), mammals with significant scientific values (e.g., captive or free specimens of endangered species), or mammals that otherwise have value. Suitable subjects also include: mice, rats, dogs, cats, ungulates such as cattle, swine, sheep, horses, and goats, lagomorphs such as rabbits and hares, other rodents, and primates such as monkeys and apes. In some aspects, subjects may be diagnosed with a microbial infection, may be at risk for a microbial infection, or may be experiencing a microbial infection. Subjects may be of any age including new born, adolescent, adult, middle age, or elderly.

The phrase "therapeutically effective amount" is used herein to mean an amount sufficient to increase to some beneficial degree, preferably to increase by at least about 1 to 100 percent, more preferably by at least about 5 to 95 percent, and more preferably by at least 8 percent or higher, healing or infection improvement as compared to untreated controls. An "effective amount" is a pharmaceutically-effective amount that is intended to qualify the amount of an agent or compound, that when administered to a subject, will achieve the goal of healing an infection site, inhibiting the growth of a microorganism, or otherwise benefiting the recipient environment.

The term "variant" relates to nucleotide or amino acid sequences which have similar sequences and that function in the same way.

Amino acid designations may include full name, three-letter, or single-letter designations as commonly understood by one of ordinary skill in the art to which this disclosure belongs.

As various changes could be made in the above compositions and methods without departing from the scope of the disclosure, it is intended that all matter contained in the above description and in the Examples given below, shall be interpreted as illustrative and not in a limiting sense.

EXAMPLES

Example 1

Antimicrobial Activity of Antimicrobial Agents

The antimicrobial agents disclosed are derivatives of SEQ. ID. NO.: 3, having 14 amino acids and a broad spectrum of antimicrobial activity. The antimicrobial agents of the disclosure were synthesized and analyzed to evaluate antimicrobial activity. Initially, the antimicrobial agent of SEQ ID NO.: 3 was evaluated for inhibition of clinical isolates of common mastitis pathogens (Table 1).

TABLE 1

Antimicrobial activity of the antimicrobial agent of SEQ ID NO.: 3 expressed as minimum inhibitory concentration (MIC).

| Clinical pathogen isolate | MIC (µM) | Bacteria strain |
| --- | --- | --- |
| 335 B-S | 12.5 | Streptococcus dysgalactiae |
| 335 B-15 | 25.0 | Klebsiella pneumoniae |
| 404 C-18 | 12.5 | Corynebacterium species |
| 416 B-10 | 25.0 | Staphylococcus aureus |
| 331 C-10 | 25.0 | Staphylococcus aureus |
| 422 C-10 | 25.0 | Staphylococcus aureus |

Additional antimicrobial agents were evaluated for antimicrobial activity, including 23 computationally-derived analogues of SEQ ID NO: 3. These analogues were grouped into two functional series, including those synthesized for improved helicity (Table 2; A-P) and those synthesized for enhanced activity (Table 2; IND, Q-T, and W-X). The antimicrobial activity of the synthetic analogues provided in Table 2 were evaluated using standard techniques such as those described in Sang, et al. 2007 Dev. Comp. Immunol., and herein incorporated by reference. Based on the data collected, three synthetic antimicrobial agents were identified (Table 2, shaded rows) as having superior antimicrobial activity compared to the agent of SEQ ID NO: 3 or SEQ ID NO: 19 (Table 2).

TABLE 2

Antimicrobial activity of analogs against Staphylococcus aureus expressed as minimum inhibitory concentration (MIC).

| Peptide | Helicity Score | MW | MIC |
| --- | --- | --- | --- |
| A (SEQ ID NO: 3) | 3.64 | 1774.8 | 16.0 |
| B (SEQ ID NO: 4) | 11.12 | 1748.84 | 64.0 |
| C (SEQ ID NO: 5) | 14.39 | 1776.22 | >256.0 |
| D (SEQ ID NO: 6) | 20.37 | 1790.25 | >256.0 |
| E (SEQ ID NO: 7) | 3.72 | 1744.18 | 256.0 |
| F (SEQ ID NO: 8) | 13.13 | 1718.14 | 8.0 |
| G (SEQ ID NO: 9) | 16.91 | 1746.19 | 16.0 |
| H (SEQ ID NO: 10) | 23.70 | 1760.22 | 16.0 |
| I (SEQ ID NO: 11) | 3.12 | 1774.21 | 16.0 |
| J (SEQ ID NO: 12) | 9.80 | 1748.17 | >256.0 |
| K (SEQ ID NO: 13) | 12.75 | 1776.22 | >256.0 |

TABLE 2-continued

| | | | |
|---|---|---|---|
| L (SEQ ID NO: 14) | 18.22 | 1790.25 | >256.0 |
| M (SEQ ID NO: 15) | 3.15 | 1744.28 | >256.0 |
| N (SEQ ID NO: 16) | 11.47 | 1718.14 | 4.0 |
| O (SEQ ID NO: 17) | 14.84 | 1746.19 | 4.0 |
| P (SEQ ID NO: 18) | 18.73 | 1760.22 | 64.0 |
| IND (SEQ ID NO: 19) | 3.64 | 1901.27 | 64.0 |
| Q (SEQ ID NO: 20) | 0.17 | 1758.16 | >256.0 |
| R (SEQ ID NO: 21) | 13.2 | 1783.22 | 32.0 |
| S (SEQ ID NO: 22) | 21.7 | 1767.17 | 256.0 |
| T (SEQ ID NO: 23) | 11.7 | 1831.22 | >256.0 |
| W (SEQ ID NO: 24) | 5.0 | 1788.19 | >256.0 |
| X (SEQ ID NO: 25) | 6.2 | 1797.20 | >256.0 |

Example 2

Structural/Function Analysis of Antimicrobial Agents

The structure/function mechanisms for the antimicrobial agents described herein were evaluated. In order to develop a better understanding of the effects of different amino acids at different positions as well as developing the most biologically active and stable synthetic peptide(s), Quantitative Structure-Activity Relationship (QSAR) modeling was used to guide the optimization of multi-drug resistant *Staphylococcus aureus* antimicrobial formulations.

Figure 5:
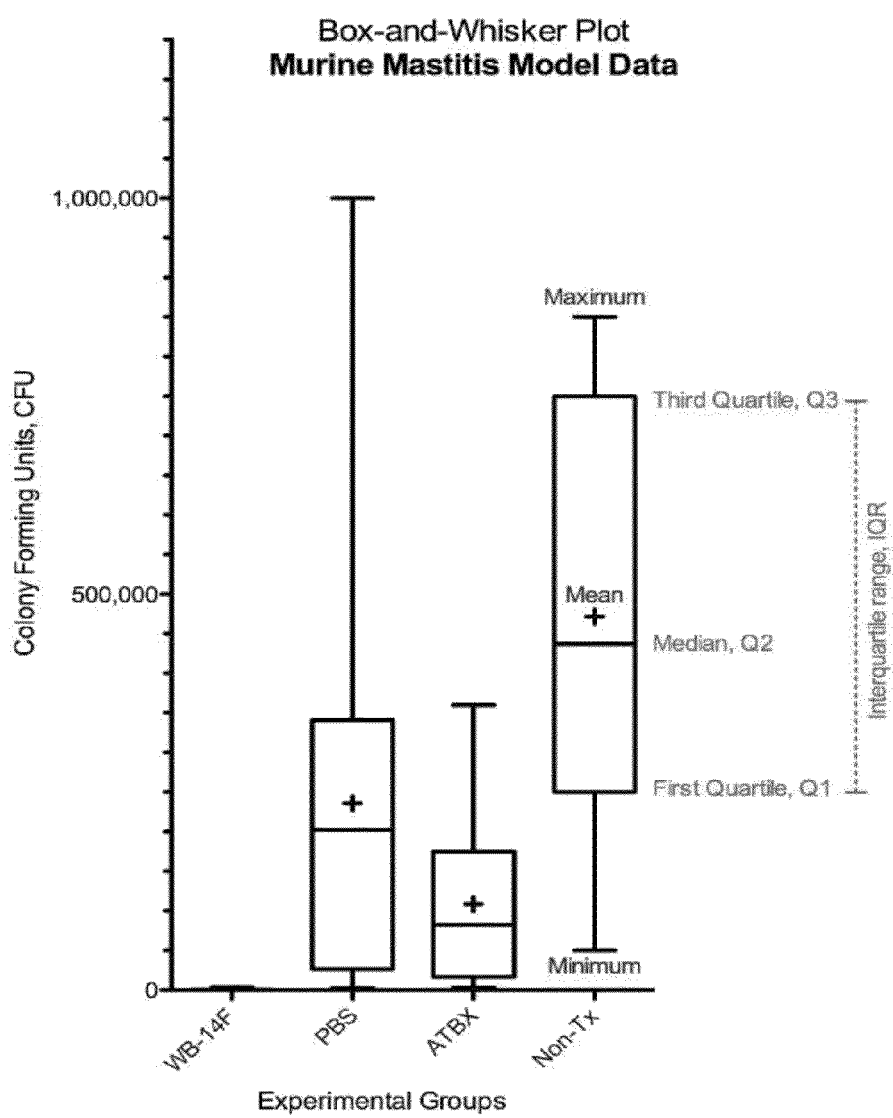
FIG. 5 graphically illustrates the antibiotic activity of the antimicrobial peptides of the disclosure. A statistically significant difference (P<0.001) was found between the groups (box-plot below), with the post-hoc test showing a difference between the WB-14F versus the three control groups (PBS, ATBX, and Non-Tx) at a 5% level of significance.
Figure 6:
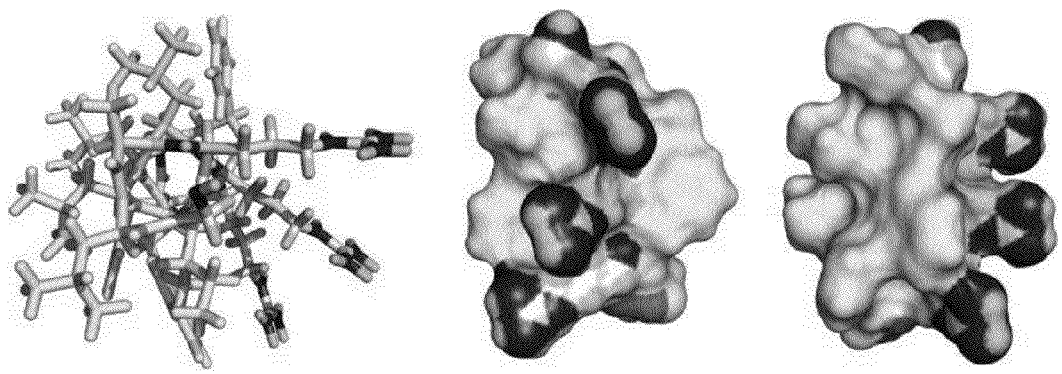
FIG. 6 depicts an antimicrobial agent (SEQ ID NO: 17) rendered as sticks (left; as shown above the helical axis) and solvent-accessible surface (center and right, as shown from front and side views, with the helical axis pointing up in the plane of the page). Coloration is as follows: hydrophobic residues are yellow; polar residues are colored by element (H=cyan, C=white, N=blue, 0=red).

Among the four main mechanisms for cellular peptidic antimicrobial action, two (the barrel-stave and toroidal pore) models require stable amphiphilic helical peptides, and a third (in-plane diffusion) requires significant intramolecular stabilization as may be achieved by secondary (helices or sheets) or tertiary (disulphide bonds or salt bridges) structural elements that can guarantee preservation of peptidic amphiphilicity. For peptide families that are known to possess antimicrobial activity and have structural aspects indicative of helix formation (i.e., few or no prolines; sequence with polar-nonpolar alternating in period of about 4 monomers), it is reasonable to assume that the bioactive conformation of the peptide is helical, and that the mechanism of action is one of the three listed above. From this assumption, the antimicrobial agents provided herein have been tailored to have a high helical propensity (as predicted via the Agadir software) and to display substantial amphiphilicity in helical conformation. Such attributes are depicted in FIG. 5 for one of the most potent antimicrobial agents described herein, SEQ ID NO: 17.

Figure 7:
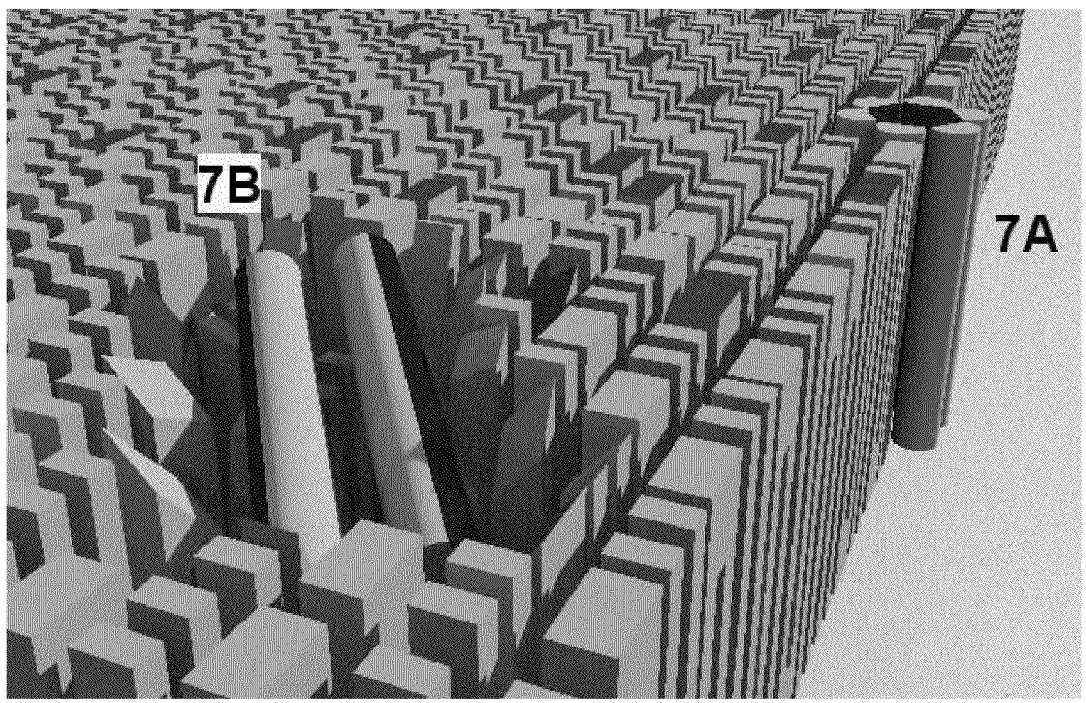
FIG. 7 shows a membrane disruption model. Toroidal pore formation (FIG. 7A) in which the peptide lipophilic surface coordinates the lipid medium in a systematic way, so as to collaboratively form a transmembrane pore, or in-plane diffusion (FIG. 7B). Individual peptides or dimers locally disrupt the membrane order via a combination of lipophilic peptide-membrane interactions and cationic attraction of the negatively charged phospholipid head groups (red surfaces) by positively charged peptide amino acids (blue surfaces), with the local pockets of disorder diffusively aggregating to form areas of significant membrane weakness.

The classic signature of the barrel-stave model is a periodic alternation of hydrophobic, anionic, hydrophobic and cationic patches, enabling the peptides to electrostatically self-assemble in cellular membranes into stable pores that exclude the surrounding lipids and compromise membrane integrity. The antimicrobial agents described herein are strictly cationic, thus obviating the barrel-stave model since a given peptide generally associates more preferentially with the lipid medium than with other peptides. However, they may still significantly interfere with the membrane via either of the remaining two possible models depicted in FIG. 7.

The high degrees of helical stability and amphiphilicity evident in the peptide formulations strongly suggests either the formation of toroidal pores which span microbe cell membranes inducing cell ion leakage (FIG. 7A), or else the formation of dimers whose selective lipid interactions disrupt the geometric regularity and stability of the lipid membrane, where these interaction include peptide cation interactions with lipid anions, and peptide aryl disruption of lipid aliphatic/aliphatic interactions.

Based on the examples described herein, the antimicrobially-potent peptide formulations based primarily on improving helical propensity and amphiphilicity profiles suggest that the observed activity arises from one of the above two mechanisms. The highly systematic nature of the peptides (rigorously hydrophobic, except for arginines in every fourth or fifth position) argues for the more structurally regular model of a toroidal pore (which could functionally assume the role of a voltage-gated channel to compromise cellular pH as per the KvAP peptide). However, the short length of antimicrobial agent peptides (~21 Å from end-to-end in helical conformation) implies that they may not be long enough to span the membrane, which would argue for the in-plane diffusion model.

Some very basic qualitative rules to explain observed antimicrobial activity trends have been resolved.

1) Given Trp in sequence position 4, peptide activity is proportional to the steric compactness of the lipophilic residue at position 3 (i.e., Pro>Ala>Val>Leu), which suggests that spatial compactness is optimal toward the N-terminus of the peptide,
2) If position 4 has anything other than a large lipophile, the backbone kink induced by proline is intolerable at position 3, and proline is not tolerated at all at any other position,
3) Given Arg in position 4, peptide activity varies according to Ala-3>Val-3>Leu-3>Pro-3, which is to say that spatial compactness is desirable, but the backbone kink induced by proline is unacceptable in this case, and
4) Interchanging residues at positions 12 and 13 does not have a major effect on activity, but significant changes to only one of these residues kills activity, indicating that the lipophilic/electropositive balance in this region is critical to activity.

To differentiate between the two mechanisms of action paradigms described in the previous section, one strategy would be to selectively substitute aromatic residues (i.e., Phe, Trp) for aliphatic (Ile, Leu) and vice versa. These substitutions should generally preserve the amphiphilicity that is required in both models, and some substitutions may enhance helical stability (which also favors both models), however their effect may vary as follows:

a) Aryl groups, being planar, are more compact than the branched alkyl groups in Ile and Leu side chains and stack better with the planar guanine groups in the requisite arginines, which may favor the formation of orderly pores that interface well with the membrane, while b) Alkyl groups are inherently more attractive to the predominantly alkyl lipid medium, but their branched nature tends to produce more structural disorder as per the in-plane diffusion scenario.

Having elucidated some important structure/function trends, Agadir calculations on conservative substitutions (i.e., ones that change the size and electrostatic character of a residue a little but not much) were performed to further optimize the antimicrobial activity of the WB synthetic peptides. Therefore, the peptides listed below (SEQ ID NO: 26-33) were synthesized and evaluated to capitalize on their helical stability (Table 3).

TABLE 3

Antimicrobial agents optimized for helical stability.

| Peptide | Sequence |
|---|---|
| WB14-F1 (SEQ ID NO: 26) | GLARILLRLLFFRG |
| WB14-N1 (SEQ ID NO: 27) | GLARILLRLLFRFG |
| WB14-O1 (SEQ ID NO: 28) | GLVRILLRLLFRFG |
| WB14-O2 (SEQ ID NO: 29) | GLVRILLRLLLRFG |
| WB14-O3 (SEQ ID NO: 30) | SLVRILLRLLLRFG |
| WB14-O4 (SEQ ID NO: 31) | GLTRILLRLLLRFG |
| WB14-O5 (SEQ ID NO: 32) | GLVRILLRLLLRYG |
| WB14-O6 (SEQ ID NO: 33) | GLVRILLRLLLRFS |

Example 3

Antimicrobial Activity of Antimicrobial Agent Analogs

The additional antimicrobial agent analogs optimized for helical stability in Example 2 (Table 3) were evaluated for antimicrobial activity. The antimicrobial activity of the synthetic analogues provided in Table 3 were evaluated using standard techniques such as those described in Sang, et al. 2007 Dev. Comp. Immunol., and herein incorporated by reference. The antimicrobial activity of the agents is provided in Table 4.

TABLE 4

Antimicrobial Activity of helical stability optimized agents against *Staphylococcus aureus* (Minimum Inhibitory Concentration: MIC in μg/ml).

| Peptide | SEQ ID No. | Sequence | MIC duplicates |
|---|---|---|---|
| WB14-A | SEQ ID NO: 3 | GLPWILLRWLFFRG | 8.0, 16.0 |
| WB14-F | SEQ ID NO: 8 | GLARILLRWLFFRG | 2.0, 4.0 |
| WB14-N | SEQ ID NO: 16 | GLARILLRWLFRFG | 4.0, 4.0 |
| WB14-O | SEQ ID NO: 17 | GLVRILLRWLFRFG | 16.0, 8.0 |
| WB14-F1 | SEQ ID NO: 26 | GLARILLRLLFFRG | 8.0, 8.0 |
| WB14-N1 | SEQ ID NO: 27 | GLARILLRLLFRFG | 128, 128 |
| WB14-O1 | SEQ ID NO: 28 | GLVRILLRLLFRFG | 64, 128 |
| WB14-O2 | SEQ ID NO: 29 | GLVRILLRLLLRFG | 256, 128 |
| WB14-O3 | SEQ ID NO: 30 | SLVRILLRLLLRFG | 128, 128 |
| WB14-O4 | SEQ ID NO: 31 | GLTRILLRLLLRFG | 256, 256 |
| WB14-O5 | SEQ ID NO: 32 | GLVRILLRLLLRYG | 64, 128 |
| WB14-O6 | SEQ ID NO: 33 | GLVRILLRLLLRFS | >256, >256 |

The results indicated that the antimicrobial agent having SEQ ID NO: 8 was the most efficacious antimicrobial synthetic peptide. The antimicrobial activity of SEQ ID NO. 8 was further evaluated against clinical isolates of mastitis-causing bacteria (Table 5).

TABLE 5

In vitro antimicrobial activity of the WB-14F peptide (SEQ ID NO.: 8) against clinical isolates of mastitis-causing bacteria.

| Clinical Isolate | Bacterial strain | Multidrug resistance | MIC (μg/ml) |
|---|---|---|---|
| 335-B05 | *Streptococcus dysgalactiae* | ++ | 8.0 |
| 335-B15 | *Klebsiella pneumoniae* | ++++ | 16.0 |
| 404-C18 | *Corynebacterium* species | ++ | 16.0 |
| 416-B10 | *Staphylococcus aureus* | +++ | 2.0 |
| 212-B05 | *Escherichia coli* | ++ | 4.0 |
| BAA 44* (ATCC) | *Staphylococcus aureus* | +++++ | 4.0 |

The WB-14F was synthesized under the following conditions: >95% purity; TFA salt; All were L-amino acids; No terminal modification;
*ATCC cat. No. BAA 44.

Example 4

In Vivo Analysis of Antimicrobial Activity

The antimicrobial agent of SEQ ID NO: 8 was evaluated using an in vivo model of bacterial infection to assess the antimicrobial activity of the agent. The following methods and materials were used.

Bacterial Strain.

*Staphylococcus aureus* was isolated from milk from dairy cows with clinical mastitis (Livestock Disease Diagnostic Center, University of Kentucky. Lexington, Ky.). Upon arrival, bacteria were striped on blood agar plates (TSA+5% sheep blood from Remel, Kansas City. MO) and cultured at 37° C. for 24 hrs. A fresh single bacterial colony picked from the agar plate was inoculated into 10 ml of Muller Hinton II broth (MHB) and cultured at 37° C. for 4-6 hrs. until reaching an absorbance of 0.8 with a 625 nm spectrophotometer filter. At this absorbance, the MHB has been documented to contain $1 \times 10^5$ colony forming units (CFU) in a 50 μl volume.

Synthesis of the Water Buffalo Host Defense Peptide. The WB-14F peptide (SEQ ID NO: 8; GLARILLRWLFFRG) was chemically synthesized (Peptide 2.0; Chantilly, Va.). After synthesis, the WB-14F molecule eluted in a single peak on RP-HPLC, and confirmed by mass spectroscopy. Final purity of the peptide was >97% with a molecular weight of 1718.4. The peptide was lyophilized and stored at −80° C. until use.

Mastitis Mouse Model.

For the experiment, 56 female Balb/c mice (BW ~50 g) at 7-10 days of lactation were used. Four groups of n=14 mice were used for each experiment as described below. For intramammary inoculation the protocol described by Chandler was followed (*J. Med. Microbiol.* V3; 273-282: 1970) with minor modifications. Briefly, lactating mothers were separated from the pups 4 hours before inoculation. Then, pups were allowed to lactate for 1 hour before inoculation to empty the mammary glands. Pups were separated again from the mother and never reunited with her afterwards. After that, mice were anesthetized with a combination of Tiletamine/

Zolazepam (Zoletil® 100, Virbac) at a dose of 100 mg/kg IM, and the mammary glands were disinfected with 70% alcohol. Using a stereoscopic microscope a 50 µL of the previously prepared S. aureus suspension (containing $1 \times 10^5$ CFU) was inoculated intra-mammarily. Injections were made slowly, using a 33 G needle (Hamilton, Kent, UK), into the left and right abdominal teats (L4 and R4). After inoculation mice were allowed to recover from the anesthesia.

Therapeutic Effect of the WB-14F Compared to Controls and Antibiotic Treated Groups.

Mice (n=14/group) were treated intra-mammarily using the stereoscopic technique as follows: Group 1: WB-14F (32 µg diluted in 50 µL sterile PBS per gland); Group 2: Control, Sterile Phosphate Buffered Saline (50 µL per gland); Group 3: Ceptiofur (400 µg diluted in 50 µl mineral oil per gland); Group 4: infected but untreated. All groups (except Group 4) received the treatments 24 hours post-infection every 24 hrs. for 3 consecutive days (total of 3 treatments).

Determination of Colony Forming Units (CFU) in Mammary Glands.

All mice were euthanized (using $CO_2$) following the AVMA euthanasia guidelines 24 hours after the last treatment. The infected mammary glands (L4 and R4) were removed individually using soft tissue dissection and homogenized in 1 ml of sterile PBS in Falcon tubes using a Polytron tissue homogenizer (Kinematica, Switzerland). Dilutions ($10^{-1}$, $10^{-2}$, and $10^{-3}$) of the homogenates were plated quantitatively to determine the number of CFU per gland. Results were reported as the average of the results from the two glands (L4 and R4) from each animal.

Statistical Analysis.

Kruskal-Wallis with Dunn's post-test was performed using GraphPad Prism Ver. 5.0a for Mac, GraphPad Software, San Diego Calif. USA. A statistically significant difference (P<0.001) was found between the groups (FIG. 5), with the post-hoc test showing a difference between the WB-14F versus the three control groups (PBS, ATBX, and N1901.27on-Tx) at a 5% level of significance.

Example 5

Structural/Functional Analysis of Linked Dimer Peptide Antimicrobial Agents

A key component of the preliminary design and screening of covalently-linker peptide dimer formulations entailed the use of molecular dynamics simulations.

Figure 3:
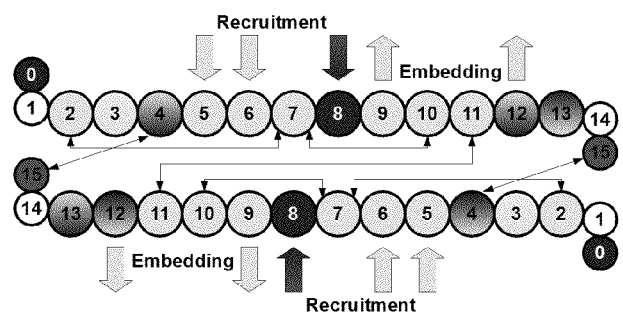
FIG. 3 graphically illustrates the roles for specific amino acid positions within the noncovalent dimer construct for some antimicrobial agent aspects. The illustration shows intradimer stabilizations (black arrows), dimer-membrane lipid interactions (yellow arrows) and dimer-membrane electrostatic coupling (red-blue arrows).
Figure 4:
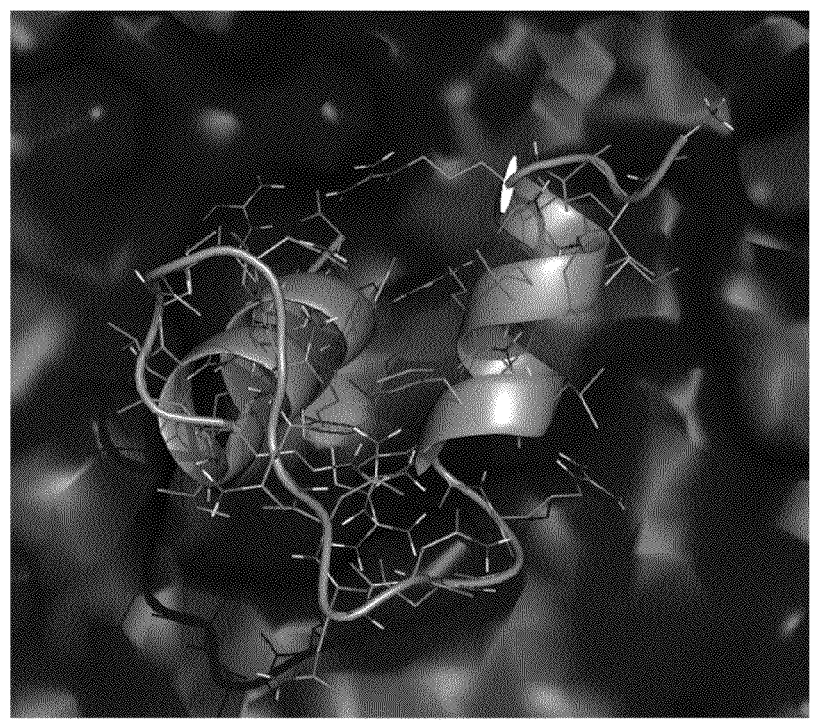
FIG. 4 graphically illustrates a minimally-spanned covalently-linked dimer based on the non-covalent formulation shown in FIG. 1. The dimer (silver cartoon and CPK-colored sticks) is shown on a model membrane surface, colored by neutral (blue) vs. anionic (red) lipids.

The sequence-specific activity dependence observed from in vivo studies is closely corroborated by intradimer interactions observed in molecular dynamics simulations of unlinked (non-covalent) peptide dimers. Subsequent molecular dynamics simulations have produced strong evidence that the interactions evident in the non-covalent dimers (shown graphically in FIG. 3) are preserved or amplified in specially-formulated covalently-linked dimers (as shown in FIG. 4).

Key structural features of the non-covalent and covalently-linked dimer systems that best corroborate experimental in vivo activities include 1) preservation of monomer helical structure, 2) retention of intradimer lipophilic and electrostatic coupling, plus strong evidence of both of the following intermolecular interactions: 3) peptide/membrane nonpolar coupling whereby peptide aryl amino acids interact with membrane lipids so as to insert aryl groups between individual lipid molecules, and 4) peptide/membrane electrostatic coupling between peptide cationic residues and anionic lipid head groups. For each of these four interaction classes, specific quantitative metrics were defined based on the relative percentage of simulation time in which specific atoms of the peptide reside within set distances of specific atoms of the intramolecular or intermolecular interaction partners. Specifically, consistent preservation of non-polar interatomic distances of no more than 4.0 Angstroms were used to identify preservation of key nonpolar features, and consistent preservation of polar interatomic distances of no more than 2.5 Angstroms were used to identify preservation of key polar features.

The four structural features described above were found via molecular dynamics simulations to be particularly well preserved or amplified by the following specific covalent linker formulations: DNNNNNN (SEQ ID NO: 34); DGGGGGG (SEQ ID NO: 38); DNNNNN (SEQ ID NO: 35); and, DGGGGG (SEQ ID NO: 37), wherein each of the above cases the N-terminus of linker sequence covalently couples via a normal peptide bond to the C-terminus of the first peptide monomer, and the C-terminus of the linker sequence covalently couples via a normal peptide bond to the N-terminus of the second peptide monomer.

The invention illustratively disclosed herein suitably may be practiced in the absence of any element, which is not specifically disclosed herein. It is apparent to those skilled in the art, however, that many changes, variations, modifications, other uses, and applications to the method are possible, and also changes, variations, modifications, other uses, and applications which do not depart from the spirit and scope of the disclosure are deemed to be covered by the disclosure, which is limited only by the claims which follow.

SEQUENCE LISTING (4102 sequences)

SEQ ID NO: 1 - DNA, 517 bp, Bubalus arnee
ggaccatgcagacccagagggccagcctctcgttggggcggtggtcactgtggcttctgctgctgggcctagtggtaccctcggccagcgcccaggacctcagctacagggaggccgtgcttcgtgctgtggatcagctcaatgagcggtcctcagaagctaatctctaccgcctcctggtgctagacccacctctcaaggatgatgcagatctgggcactcgaaagcctgtgagcttcacggtgaaggagactgtgtgccccaggacgactcagcagcctgcggagcagtgtgacttcaaggagaaagggcgggtgaaacagtgtgtggggacagtcaccctggacccgtccaatgaccagtttgacctaaactgtaatgcgctccagagtgtcggcctaccctggatattgctacggtggcttttctttagaggttgagggagaatagctatcagatcctgagcctggggaagagtcttaagtgtctgatttgttcagattcgggcttctggaca

SEQ ID NO: 2 - protein, 144 aa, Bubalus arnee
MQTQRASLSLGRWSLWLLLLGLVVPSASAQDLSYREAVLRAVDQLNERSSEANLYRLLVLDPPLKDDADLGTRKPVSFTVKETVCPRTTQQPAEQCDFKEKGRVKQCVGTVTLDPSNDQFDLNCNALQSVGLPWILLRWLFFRG

SEQ ID NO: 3 - protein, 14 aa, Artificial Sequence
  Antimicrobial peptide sequence
GLPWILLRWLFFRG

SEQ ID NO: 4 - protein, 14 aa, Artificial Sequence
  Antimicrobial peptide sequence
GLAWILLRWLFFRG

SEQ ID NO: 5 - protein, 14 aa, Artificial Sequence
  Antimicrobial peptide sequence
GLVWILLRWLFFRG

SEQ ID NO: 6 - protein, 14 aa, Artificial Sequence
  Antimicrobial peptide sequence
GLLWILLRWLFFRG

SEQ ID NO: 7 - protein, 14 aa, Artificial Sequence
  Antimicrobial peptide sequence
GLPRILLRWLFFRG

SEQ ID NO: 8 - protein, 14 aa, Artificial Sequence
  Antimicrobial peptide sequence
GLARILLRWLFFRG

SEQ ID NO: 9 - protein, 14 aa, Artificial Sequence
  Antimicrobial peptide sequence
GLVRILLRWLFFRG

SEQ ID NO: 10 - protein, 14 aa, Artificial Sequence
  Antimicrobial peptide sequence
GLLRILLRWLFFRG

SEQ ID NO: 11 - protein, 14 aa, Artificial Sequence
  Antimicrobial peptide sequence
GLPWILLRWLFRFG

SEQ ID NO: 12 - protein, 14 aa, Artificial Sequence
  Antimicrobial peptide sequence
GLAWILLRWLFRFG

SEQ ID NO: 13 - protein, 14 aa, Artificial Sequence
  Antimicrobial peptide sequence
GLVWILLRWLFRFG

SEQ ID NO: 14 - protein, 14 aa, Artificial Sequence
  Antimicrobial peptide sequence
GLLWILLRWLFRFG

SEQ ID NO: 15 - protein, 14 aa, Artificial Sequence
  Antimicrobial peptide sequence
GLPRILLRWLFRFG

SEQ ID NO: 16 - protein, 14 aa, Artificial Sequence
  Antimicrobial peptide sequence
GLARILLRWLFRFG

SEQ ID NO: 17 - protein, 14 aa, Artificial Sequence
  Antimicrobial peptide sequence
GLVRILLRWLFRFG

SEQ ID NO: 18 - protein, 14 aa, Artificial Sequence
  Antimicrobial peptide sequence
GLLRILLRWLFRFG

SEQ ID NO: 19 - protein, 13 aa, Artificial Sequence
  Antimicrobial peptide sequence
IPWKWPWWFWRRG

SEQ ID NO: 20 - protein, 14 aa, Artificial Sequence
  Antimicrobial peptide sequence
GLPWILPRWLFFRG

SEQ ID NO: 21 - protein, 14 aa, Artificial Sequence
  Antimicrobial peptide sequence
GLPWILLRWLFRRG

SEQ ID NO: 22 - protein, 14 aa, Artificial Sequence
  Antimicrobial peptide sequence
GLPWILPRWLFRRG

SEQ ID NO: 23 - protein, 14 aa, Artificial Sequence
  Amino acid sequence
GLPWIWPRWLFFRG

SEQ ID NO: 24 - protein, 14 aa, Artificial Sequence
  Antimicrobial peptide sequence
GLPWILPWWLFFRG

SEQ ID NO: 25 - protein, 14 aa, Artificial Sequence
  Antimicrobial peptide sequence
GLPWILPRWLWFRG

SEQ ID NO: 26 - protein, 14 aa, Artificial Sequence
  Antimicrobial peptide sequence
GLARILLRLLFFRG

SEQ ID NO: 27 - protein, 14 aa, Artificial Sequence
  Antimicrobial peptide sequence
GLARILLRLLFRFG

SEQ ID NO: 28 - protein, 14 aa, Artificial Sequence
  Antimicrobial peptide sequence
GLVRILLRLLFRFG

SEQ ID NO: 29 - protein, 14 aa, Artificial Sequence
  Antimicrobial peptide sequence
GLVRILLRLLLRFG

SEQ ID NO: 30 - protein, 14 aa, Artificial Sequence
  Antimicrobial peptide sequence
SLVRILLRLLLRFG

SEQ ID NO: 31 - protein, 14 aa, Artificial Sequence
  Antimicrobial peptide sequence
GLTRILLRLLLRFG

SEQ ID NO: 32 - protein, 14 aa, Artificial Sequence
  Antimicrobial peptide sequence
GLVRILLRLLLRYG

SEQ ID NO: 33 - protein, 14 aa, Artificial Sequence
  Antimicrobial peptide sequence
GLVRILLRLLLRFS

SEQ ID NO: 34 - protein, 7 aa, Artificial Sequence
  Antimicrobial peptide sequence
DNNNNNN

SEQ ID NO: 35 - protein, 6 aa, Artificial Sequence
  Antimicrobial peptide sequence
DNNNNN

SEQ ID NO: 36 - protein, 8 aa, Artificial Sequence
  Antimicrobial peptide sequence
DNNNNNNN

SEQ ID NO: 37 - protein, 6 aa, Artificial Sequence
  Antimicrobial peptide sequence
DGGGGG

SEQ ID NO: 38 - protein, 7 aa, Artificial Sequence
  Antimicrobial peptide sequence
DGGGGGG

SEQ ID NO: 39 - protein, 8 aa, Artificial Sequence
  Antimicrobial peptide sequence
DGGGGGGG

SEQ ID NO: 40 - protein, 35 aa, Artificial Sequence
  Antimicrobial peptide sequence
GLARILLRWLFFRGDGGGGGGGLARILLRWLFFRG

SEQ ID NO: 41 - protein, 35 aa, Artificial Sequence
  Antimicrobial peptide sequence
GLARILLRWLFFRGDNNNNNNGLARILLRWLFFRG

SEQ ID NO: 42 - protein, 35 aa, Artificial Sequence
  Antimicrobial peptide sequence
GLARILLRWLFRFGDGGGGGGGLARILLRWLFRFG

SEQ ID NO: 43 - protein, 35 aa, Artificial Sequence
  Antimicrobial peptide sequence
GLARILLRWLFRFGDNNNNNNGLARILLRWLFRFG

SEQ ID NO: 44 - protein, 35 aa, Artificial Sequence
  Antimicrobial peptide sequence
GLARILLRLLFFRGDGGGGGGGLARILLRLLFFRG

SEQ ID NO: 45 - protein, 35 aa, Artificial Sequence
  Antimicrobial peptide sequence
GLARILLRLLFFRGDNNNNNNGLARILLRLLFFRG

SEQ ID NO: 46 - protein, 34 aa, Artificial Sequence
  Antimicrobial peptide sequence
GLARILLRWLFFRGDGGGGGGLARILLRWLFFRG

SEQ ID NO: 47 - protein, 34 aa, Artificial Sequence
  Antimicrobial peptide sequence
GLARILLRWLFFRGDNNNNNGLARILLRWLFFRG

SEQ ID NO: 48 - protein, 34 aa, Artificial Sequence
  Antimicrobial peptide sequence
GLARILLRWLFRFGDGGGGGGLARILLRWLFRFG

SEQ ID NO: 49 - protein, 34 aa, Artificial Sequence
  Antimicrobial peptide sequence
GLARILLRWLFRFGDNNNNNGLARILLRWLFRFG

SEQ ID NO: 50 - protein, 34 aa, Artificial Sequence
  Antimicrobial peptide sequence
GLARILLRLLFFRGDGGGGGGLARILLRLLFFRG

SEQ ID NO: 51 - protein, 34 aa, Artificial Sequence
  Antimicrobial peptide sequence
GLARILLRLLFFRGDNNNNNGLARILLRLLFFRG

SEQ ID NO: 52 - protein, 33 aa, Artificial Sequence
  Antimicrobial peptide sequence
GLPWILLRWLFFRGDGGGGGLPWILLRWLFFRG

SEQ ID NO: 53 - protein, 33 aa, Artificial Sequence
  Antimicrobial peptide sequence
GLPWILLRWLFFRGDGGGGGLARILLRWLFFRG

SEQ ID NO: 54 - protein, 33 aa, Artificial Sequence
  Antimicrobial peptide sequence
GLPWILLRWLFFRGDGGGGGLARILLRWLFRFG

SEQ ID NO: 55 - protein, 33 aa, Artificial Sequence
  Antimicrobial peptide sequence
GLPWILLRWLFFRGDGGGGGLVRILLRWLFRFG

SEQ ID NO: 56 - protein, 33 aa, Artificial Sequence
  Antimicrobial peptide sequence
GLPWILLRWLFFRGDGGGGGLARILLRLLFFRG

SEQ ID NO: 57 - protein, 33 aa, Artificial Sequence
  Antimicrobial peptide sequence
GLPWILLRWLFFRGDGGGGGLARILLRLLFRFG

SEQ ID NO: 58 - protein, 33 aa, Artificial Sequence
  Antimicrobial peptide sequence
GLPWILLRWLFFRGDGGGGGLVRILLRLLFRFG

SEQ ID NO: 59 - protein, 33 aa, Artificial Sequence
  Antimicrobial peptide sequence
GLPWILLRWLFFRGDGGGGSLVRILLRLLLRFG

SEQ ID NO: 60 - protein, 33 aa, Artificial Sequence
  Antimicrobial peptide sequence
GLPWILLRWLFFRGDGGGGGLVRILLRLLLRYG

SEQ ID NO: 61 - protein, 33 aa, Artificial Sequence
  Antimicrobial peptide sequence
GLPWILLRWLFFRGDGGGGGLAWILLRWLFFRG

SEQ ID NO: 62 - protein, 33 aa, Artificial Sequence
  Antimicrobial peptide sequence
GLPWILLRWLFFRGDGGGGGLVRILLRWLFFRG

SEQ ID NO: 63 - protein, 33 aa, Artificial Sequence
  Antimicrobial peptide sequence
GLPWILLRWLFFRGDGGGGGLLRILLRWLFFRG

SEQ ID NO: 64 - protein, 33 aa, Artificial Sequence
  Antimicrobial peptide sequence
GLPWILLRWLFFRGDGGGGGLPWILLRWLFRFG

SEQ ID NO: 65 - protein, 33 aa, Artificial Sequence
  Antimicrobial peptide sequence
GLPWILLRWLFFRGDGGGGGLLRILLRWLFRFG

SEQ ID NO: 66 - protein, 33 aa, Artificial Sequence
  Antimicrobial peptide sequence
GLPWILLRWLFFRGDGGGGGLPWILLRWLFRRG

SEQ ID NO: 67 - protein, 34 aa, Artificial Sequence
  Antimicrobial peptide sequence
GLPWILLRWLFFRGDGGGGGGLPWILLRWLFFRG

SEQ ID NO: 68 - protein, 34 aa, Artificial Sequence
  Antimicrobial peptide sequence
GLPWILLRWLFFRGDGGGGGGLARILLRWLFFRG

SEQ ID NO: 69 - protein, 34 aa, Artificial Sequence
  Antimicrobial peptide sequence
GLPWILLRWLFFRGDGGGGGGLARILLRWLFRFG

SEQ ID NO: 70 - protein, 34 aa, Artificial Sequence
  Antimicrobial peptide sequence
GLPWILLRWLFFRGDGGGGGGLVRILLRWLFRFG

SEQ ID NO: 71 - protein, 34 aa, Artificial Sequence
  Antimicrobial peptide sequence
GLPWILLRWLFFRGDGGGGGGLARILLRLLFFRG

SEQ ID NO: 72 - protein, 34 aa, Artificial Sequence
  Antimicrobial peptide sequence
GLPWILLRWLFFRGDGGGGGGLARILLRLLFRFG

SEQ ID NO: 73 - protein, 34 aa, Artificial Sequence
  Antimicrobial peptide sequence
GLPWILLRWLFFRGDGGGGGGLVRILLRLLFRFG

SEQ ID NO: 74 - protein, 34 aa, Artificial Sequence
  Antimicrobial peptide sequence
GLPWILLRWLFFRGDGGGGGSLVRILLRLLLRFG

SEQ ID NO: 75 - protein, 34 aa, Artificial Sequence
  Antimicrobial peptide sequence
GLPWILLRWLFFRGDGGGGGGLVRILLRLLLRYG

SEQ ID NO: 76 - protein, 34 aa, Artificial Sequence
  Antimicrobial peptide sequence
GLPWILLRWLFFRGDGGGGGGLAWILLRWLFFRG

SEQ ID NO: 77 - protein, 34 aa, Artificial Sequence
  Antimicrobial peptide sequence
GLPWILLRWLFFRGDGGGGGGLVRILLRWLFFRG

SEQ ID NO: 78 - protein, 34 aa, Artificial Sequence
  Antimicrobial peptide sequence
GLPWILLRWLFFRGDGGGGGGLLRILLRWLFFRG

SEQ ID NO: 79 - protein, 34 aa, Artificial Sequence
  Antimicrobial peptide sequence
GLPWILLRWLFFRGDGGGGGGLPWILLRWLFRFG

SEQ ID NO: 80 - protein, 34 aa, Artificial Sequence
  Antimicrobial peptide sequence
GLPWILLRWLFFRGDGGGGGGLLRILLRWLFRFG

SEQ ID NO: 81 - protein, 34 aa, Artificial Sequence
  Antimicrobial peptide sequence
GLPWILLRWLFFRGDGGGGGGLPWILLRWLFRRG

SEQ ID NO: 82 - protein, 35 aa, Artificial Sequence
  Antimicrobial peptide sequence
GLPWILLRWLFFRGDGGGGGGGLPWILLRWLFFRG

SEQ ID NO: 83 - protein, 35 aa, Artificial Sequence
  Antimicrobial peptide sequence
GLPWILLRWLFFRGDGGGGGGGLARILLRWLFFRG

SEQ ID NO: 84 - protein, 35 aa, Artificial Sequence
  Antimicrobial peptide sequence
GLPWILLRWLFFRGDGGGGGGGLARILLRWLFRFG

SEQ ID NO: 85 - protein, 35 aa, Artificial Sequence
  Antimicrobial peptide sequence
GLPWILLRWLFFRGDGGGGGGGLVRILLRWLFRFG

SEQ ID NO: 86 - protein, 35 aa, Artificial Sequence
  Antimicrobial peptide sequence
GLPWILLRWLFFRGDGGGGGGGLARILLRLLFFRG

SEQ ID NO: 87 - protein, 35 aa, Artificial Sequence
  Antimicrobial peptide sequence
GLPWILLRWLFFRGDGGGGGGGLARILLRLLFRFG

SEQ ID NO: 88 - protein, 35 aa, Artificial Sequence
  Antimicrobial peptide sequence
GLPWILLRWLFFRGDGGGGGGGLVRILLRLLFRFG

SEQ ID NO: 89 - protein, 35 aa, Artificial Sequence
  Antimicrobial peptide sequence
GLPWILLRWLFFRGDGGGGGGSLVRILLRLLLRFG

SEQ ID NO: 90 - protein, 35 aa, Artificial Sequence
  Antimicrobial peptide sequence
GLPWILLRWLFFRGDGGGGGGGLVRILLRLLLRYG

SEQ ID NO: 91 - protein, 35 aa, Artificial Sequence
  Antimicrobial peptide sequence
GLPWILLRWLFFRGDGGGGGGGLAWILLRWLFFRG

SEQ ID NO: 92 - protein, 35 aa, Artificial Sequence
  Antimicrobial peptide sequence
GLPWILLRWLFFRGDGGGGGGGLVRILLRWLFFRG

SEQ ID NO: 93 - protein, 35 aa, Artificial Sequence
  Antimicrobial peptide sequence
GLPWILLRWLFFRGDGGGGGGGLLRILLRWLFFRG

SEQ ID NO: 94 - protein, 35 aa, Artificial Sequence
  Antimicrobial peptide sequence
GLPWILLRWLFFRGDGGGGGGGLPWILLRWLFRFG

SEQ ID NO: 95 - protein, 35 aa, Artificial Sequence
  Antimicrobial peptide sequence
GLPWILLRWLFFRGDGGGGGGGLLRILLRWLFRFG

SEQ ID NO: 96 - protein, 35 aa, Artificial Sequence
  Antimicrobial peptide sequence
GLPWILLRWLFFRGDGGGGGGGLPWILLRWLFRRG

SEQ ID NO: 97 - protein, 36 aa, Artificial Sequence
  Antimicrobial peptide sequence
GLPWILLRWLFFRGDGGGGGGGGLPWILLRWLFFRG

SEQ ID NO: 98 - protein, 36 aa, Artificial Sequence
  Antimicrobial peptide sequence
GLPWILLRWLFFRGDGGGGGGGGLARILLRWLFFRG

SEQ ID NO: 99 - protein, 36 aa, Artificial Sequence
  Antimicrobial peptide sequence
GLPWILLRWLFFRGDGGGGGGGGLARILLRWLFRFG

SEQ ID NO: 100 - protein, 36 aa, Artificial Sequence
  Antimicrobial peptide sequence
GLPWILLRWLFFRGDGGGGGGGGLVRILLRWLFRFG

SEQ ID NO: 101 - protein, 36 aa, Artificial Sequence
  Antimicrobial peptide sequence
GLPWILLRWLFFRGDGGGGGGGGLARILLRLLFFRG

SEQ ID NO: 102 - protein, 36 aa, Artificial Sequence
  Antimicrobial peptide sequence
GLPWILLRWLFFRGDGGGGGGGGLARILLRLLFRFG

SEQ ID NO: 103 - protein, 36 aa, Artificial Sequence
  Antimicrobial peptide sequence
GLPWILLRWLFFRGDGGGGGGGGLVRILLRLLFRFG

SEQ ID NO: 104 - protein, 36 aa, Artificial Sequence
  Antimicrobial peptide sequence
GLPWILLRWLFFRGDGGGGGGGSLVRILLRLLLRFG

SEQ ID NO: 105 - protein, 36 aa, Artificial Sequence
  Antimicrobial peptide sequence
GLPWILLRWLFFRGDGGGGGGGGLVRILLRLLLRYG

SEQ ID NO: 106 - protein, 36 aa, Artificial Sequence
  Antimicrobial peptide sequence
GLPWILLRWLFFRGDGGGGGGGGLAWILLRWLFFRG

SEQ ID NO: 107 - protein, 36 aa, Artificial Sequence
  Antimicrobial peptide sequence
GLPWILLRWLFFRGDGGGGGGGGLVRILLRWLFFRG

SEQ ID NO: 108 - protein, 36 aa, Artificial Sequence
  Antimicrobial peptide sequence
GLPWILLRWLFFRGDGGGGGGGGLLRILLRWLFFRG

SEQ ID NO: 109 - protein, 36 aa, Artificial Sequence
  Antimicrobial peptide sequence
GLPWILLRWLFFRGDGGGGGGGGLPWILLRWLFRFG

SEQ ID NO: 110 - protein, 36 aa, Artificial Sequence
  Antimicrobial peptide sequence
GLPWILLRWLFFRGDGGGGGGGGLLRILLRWLFRFG

SEQ ID NO: 111 - protein, 36 aa, Artificial Sequence
  Antimicrobial peptide sequence
GLPWILLRWLFFRGDGGGGGGGGLPWILLRWLFRRG

SEQ ID NO: 112 - protein, 33 aa, Artificial Sequence
  Antimicrobial peptide sequence
GLPWILLRWLFFRGDNNNNGLPWILLRWLFFRG

SEQ ID NO: 113 - protein, 33 aa, Artificial Sequence
  Antimicrobial peptide sequence
GLPWILLRWLFFRGDNNNNGLARILLRWLFFRG

SEQ ID NO: 114 - protein, 33 aa, Artificial Sequence
  Antimicrobial peptide sequence
GLPWILLRWLFFRGDNNNNGLARILLRWLFRFG

SEQ ID NO: 115 - protein, 33 aa, Artificial Sequence
  Antimicrobial peptide sequence
GLPWILLRWLFFRGDNNNNGLVRILLRWLFRFG

SEQ ID NO: 116 - protein, 33 aa, Artificial Sequence
  Antimicrobial peptide sequence
GLPWILLRWLFFRGDNNNNGLARILLRLLFFRG

SEQ ID NO: 117 - protein, 33 aa, Artificial Sequence
  Antimicrobial peptide sequence
GLPWILLRWLFFRGDNNNNGLARILLRLLFRFG

SEQ ID NO: 118 - protein, 33 aa, Artificial Sequence
  Antimicrobial peptide sequence
GLPWILLRWLFFRGDNNNNGLVRILLRLLFRFG

SEQ ID NO: 119 - protein, 33 aa, Artificial Sequence
  Antimicrobial peptide sequence
GLPWILLRWLFFRGDNNNNSLVRILLRLLLRFG

SEQ ID NO: 120 - protein, 33 aa, Artificial Sequence
  Antimicrobial peptide sequence
GLPWILLRWLFFRGDNNNNGLVRILLRLLLRYG

SEQ ID NO: 121 - protein, 33 aa, Artificial Sequence
  Antimicrobial peptide sequence
GLPWILLRWLFFRGDNNNNGLAWILLRWLFFRG

SEQ ID NO: 122 - protein, 33 aa, Artificial Sequence
  Antimicrobial peptide sequence
GLPWILLRWLFFRGDNNNNGLVRILLRWLFFRG

SEQ ID NO: 123 - protein, 33 aa, Artificial Sequence
  Antimicrobial peptide sequence
GLPWILLRWLFFRGDNNNNGLLRILLRWLFFRG

SEQ ID NO: 124 - protein, 33 aa, Artificial Sequence
  Antimicrobial peptide sequence
GLPWILLRWLFFRGDNNNNGLPWILLRWLFRFG

SEQ ID NO: 125 - protein, 33 aa, Artificial Sequence
  Antimicrobial peptide sequence
GLPWILLRWLFFRGDNNNNGLLRILLRWLFRFG

SEQ ID NO: 126 - protein, 33 aa, Artificial Sequence
  Antimicrobial peptide sequence
GLPWILLRWLFFRGDNNNNGLPWILLRWLFRRG

SEQ ID NO: 127 - protein, 34 aa, Artificial Sequence
  Antimicrobial peptide sequence
GLPWILLRWLFFRGDNNNNNGLPWILLRWLFFRG

SEQ ID NO: 128 - protein, 34 aa, Artificial Sequence
  Antimicrobial peptide sequence
GLPWILLRWLFFRGDNNNNNGLARILLRWLFFRG

SEQ ID NO: 129 - protein, 34 aa, Artificial Sequence
  Antimicrobial peptide sequence
GLPWILLRWLFFRGDNNNNNGLARILLRWLFRFG

SEQ ID NO: 130 - protein, 34 aa, Artificial Sequence
  Antimicrobial peptide sequence
GLPWILLRWLFFRGDNNNNNGLVRILLRWLFRFG

SEQ ID NO: 131 - protein, 34 aa, Artificial Sequence
  Antimicrobial peptide sequence
GLPWILLRWLFFRGDNNNNNGLARILLRLLFFRG

SEQ ID NO: 132 - protein, 34 aa, Artificial Sequence
  Antimicrobial peptide sequence
GLPWILLRWLFFRGDNNNNNGLARILLRLLFRFG

SEQ ID NO: 133 - protein, 34 aa, Artificial Sequence
  Antimicrobial peptide sequence
GLPWILLRWLFFRGDNNNNNGLVRILLRLLFRFG

SEQ ID NO: 134 - protein, 34 aa, Artificial Sequence
  Antimicrobial peptide sequence
GLPWILLRWLFFRGDNNNNNSLVRILLRLLLRFG

SEQ ID NO: 135 - protein, 34 aa, Artificial Sequence
  Antimicrobial peptide sequence
GLPWILLRWLFFRGDNNNNNGLVRILLRLLLRYG

SEQ ID NO: 136 - protein, 34 aa, Artificial Sequence
  Antimicrobial peptide sequence
GLPWILLRWLFFRGDNNNNNGLAWILLRWLFFRG

SEQ ID NO: 137 - protein, 34 aa, Artificial Sequence
  Antimicrobial peptide sequence
GLPWILLRWLFFRGDNNNNNGLVRILLRWLFFRG

SEQ ID NO: 138 - protein, 34 aa, Artificial Sequence
  Antimicrobial peptide sequence
GLPWILLRWLFFRGDNNNNNGLLRILLRWLFFRG

SEQ ID NO: 139 - protein, 34 aa, Artificial Sequence
  Antimicrobial peptide sequence
GLPWILLRWLFFRGDNNNNNGLPWILLRWLFRFG

SEQ ID NO: 140 - protein, 34 aa, Artificial Sequence
  Antimicrobial peptide sequence
GLPWILLRWLFFRGDNNNNNGLLRILLRWLFRFG

SEQ ID NO: 141 - protein, 34 aa, Artificial Sequence
  Antimicrobial peptide sequence
GLPWILLRWLFFRGDNNNNNGLPWILLRWLFRRG

SEQ ID NO: 142 - protein, 35 aa, Artificial Sequence
  Antimicrobial peptide sequence
GLPWILLRWLFFRGDNNNNNNGLPWILLRWLFFRG

SEQ ID NO: 143 - protein, 35 aa, Artificial Sequence
  Antimicrobial peptide sequence
GLPWILLRWLFFRGDNNNNNNGLARILLRWLFFRG

SEQ ID NO: 144 - protein, 35 aa, Artificial Sequence
  Antimicrobial peptide sequence
GLPWILLRWLFFRGDNNNNNNGLARILLRWLFRFG

SEQ ID NO: 145 - protein, 35 aa, Artificial Sequence
  Antimicrobial peptide sequence
GLPWILLRWLFFRGDNNNNNNGLVRILLRWLFRFG

SEQ ID NO: 146 - protein, 35 aa, Artificial Sequence
  Antimicrobial peptide sequence
GLPWILLRWLFFRGDNNNNNNGLARILLRLLFFRG

SEQ ID NO: 147 - protein, 35 aa, Artificial Sequence
  Antimicrobial peptide sequence
GLPWILLRWLFFRGDNNNNNNGLARILLRLLFRFG

SEQ ID NO: 148 - protein, 35 aa, Artificial Sequence
  Antimicrobial peptide sequence
GLPWILLRWLFFRGDNNNNNNGLVRILLRLLFRFG

SEQ ID NO: 149 - protein, 35 aa, Artificial Sequence
  Antimicrobial peptide sequence
GLPWILLRWLFFRGDNNNNNNSLVRILLRLLLRFG

SEQ ID NO: 150 - protein, 35 aa, Artificial Sequence
  Antimicrobial peptide sequence
GLPWILLRWLFFRGDNNNNNNGLVRILLRLLLRYG

SEQ ID NO: 151 - protein, 35 aa, Artificial Sequence
  Antimicrobial peptide sequence
GLPWILLRWLFFRGDNNNNNNGLAWILLRWLFFRG

SEQ ID NO: 152 - protein, 35 aa, Artificial Sequence
  Antimicrobial peptide sequence
GLPWILLRWLFFRGDNNNNNNGLVRILLRWLFFRG

SEQ ID NO: 153 - protein, 35 aa, Artificial Sequence
  Antimicrobial peptide sequence
GLPWILLRWLFFRGDNNNNNNGLLRILLRWLFFRG

SEQ ID NO: 154 - protein, 35 aa, Artificial Sequence
  Antimicrobial peptide sequence
GLPWILLRWLFFRGDNNNNNNGLPWILLRWLFRFG

SEQ ID NO: 155 - protein, 35 aa, Artificial Sequence
  Antimicrobial peptide sequence
GLPWILLRWLFFRGDNNNNNNGLLRILLRWLFRFG

SEQ ID NO: 156 - protein, 35 aa, Artificial Sequence
  Antimicrobial peptide sequence
GLPWILLRWLFFRGDNNNNNNGLPWILLRWLFRRG

SEQ ID NO: 157 - protein, 36 aa, Artificial Sequence
  Antimicrobial peptide sequence
GLPWILLRWLFFRGDNNNNNNNGLPWILLRWLFFRG

SEQ ID NO: 158 - protein, 36 aa, Artificial Sequence
  Antimicrobial peptide sequence
GLPWILLRWLFFRGDNNNNNNNGLARILLRWLFFRG

SEQ ID NO: 159 - protein, 36 aa, Artificial Sequence
  Antimicrobial peptide sequence
GLPWILLRWLFFRGDNNNNNNNGLARILLRWLFRFG

SEQ ID NO: 160 - protein, 36 aa, Artificial Sequence
  Antimicrobial peptide sequence
GLPWILLRWLFFRGDNNNNNNNGLVRILLRWLFRFG

SEQ ID NO: 161 - protein, 36 aa, Artificial Sequence
  Antimicrobial peptide sequence
GLPWILLRWLFFRGDNNNNNNNGLARILLRLLFFRG

SEQ ID NO: 162 - protein, 36 aa, Artificial Sequence
  Antimicrobial peptide sequence
GLPWILLRWLFFRGDNNNNNNNGLARILLRLLFRFG

SEQ ID NO: 163 - protein, 36 aa, Artificial Sequence
  Antimicrobial peptide sequence
GLPWILLRWLFFRGDNNNNNNNGLVRILLRLLFRFG

SEQ ID NO: 164 - protein, 36 aa, Artificial Sequence
  Antimicrobial peptide sequence
GLPWILLRWLFFRGDNNNNNNNSLVRILLRLLLRFG

SEQ ID NO: 165 - protein, 36 aa, Artificial Sequence
  Antimicrobial peptide sequence
GLPWILLRWLFFRGDNNNNNNNGLVRILLRLLLRYG

SEQ ID NO: 166 - protein, 36 aa, Artificial Sequence
  Antimicrobial peptide sequence
GLPWILLRWLFFRGDNNNNNNNGLAWILLRWLFFRG

SEQ ID NO: 167 - protein, 36 aa, Artificial Sequence
  Antimicrobial peptide sequence
GLPWILLRWLFFRGDNNNNNNNGLVRILLRWLFFRG

SEQ ID NO: 168 - protein, 36 aa, Artificial Sequence
  Antimicrobial peptide sequence
GLPWILLRWLFFRGDNNNNNNNGLLRILLRWLFFRG

SEQ ID NO: 169 - protein, 36 aa, Artificial Sequence
  Antimicrobial peptide sequence
GLPWILLRWLFFRGDNNNNNNNGLPWILLRWLFRFG

SEQ ID NO: 170 - protein, 36 aa, Artificial Sequence
  Antimicrobial peptide sequence
GLPWILLRWLFFRGDNNNNNNNGLLRILLRWLFRFG

SEQ ID NO: 171 - protein, 36 aa, Artificial Sequence
  Antimicrobial peptide sequence
GLPWILLRWLFFRGDNNNNNNNGLPWILLRWLFRRG

SEQ ID NO: 172 - protein, 35 aa, Artificial Sequence
  Antimicrobial peptide sequence
GLPWILLRWLFFRGDNGNGNGGLPWILLRWLFFRG

SEQ ID NO: 173 - protein, 35 aa, Artificial Sequence
  Antimicrobial peptide sequence
GLPWILLRWLFFRGDNGNGNGGLARILLRWLFFRG

SEQ ID NO: 174 - protein, 35 aa, Artificial Sequence
  Antimicrobial peptide sequence
GLPWILLRWLFFRGDNGNGNGGLARILLRWLFRFG

SEQ ID NO: 175 - protein, 35 aa, Artificial Sequence
  Antimicrobial peptide sequence
GLPWILLRWLFFRGDNGNGNGGLVRILLRWLFRFG

SEQ ID NO: 176 - protein, 35 aa, Artificial Sequence
  Antimicrobial peptide sequence
GLPWILLRWLFFRGDNGNGNGGLARILLRLLFFRG

SEQ ID NO: 177 - protein, 35 aa, Artificial Sequence
  Antimicrobial peptide sequence
GLPWILLRWLFFRGDNGNGNGGLARILLRLLFRFG

SEQ ID NO: 178 - protein, 35 aa, Artificial Sequence
  Antimicrobial peptide sequence
GLPWILLRWLFFRGDNGNGNGGLVRILLRLLFRFG

SEQ ID NO: 179 - protein, 35 aa, Artificial Sequence
  Antimicrobial peptide sequence
GLPWILLRWLFFRGDNGNGNGSLVRILLRLLLRFG

SEQ ID NO: 180 - protein, 35 aa, Artificial Sequence
  Antimicrobial peptide sequence
GLPWILLRWLFFRGDNGNGNGGLVRILLRLLLRYG

SEQ ID NO: 181 - protein, 35 aa, Artificial Sequence
  Antimicrobial peptide sequence
GLPWILLRWLFFRGDNGNGNGGLAWILLRWLFFRG

SEQ ID NO: 182 - protein, 35 aa, Artificial Sequence
  Antimicrobial peptide sequence
GLPWILLRWLFFRGDNGNGNGGLVRILLRWLFFRG

SEQ ID NO: 183 - protein, 35 aa, Artificial Sequence
  Antimicrobial peptide sequence
GLPWILLRWLFFRGDNGNGNGGLLRILLRWLFFRG

SEQ ID NO: 184 - protein, 35 aa, Artificial Sequence
  Antimicrobial peptide sequence
GLPWILLRWLFFRGDNGNGNGGLPWILLRWLFRFG

SEQ ID NO: 185 - protein, 35 aa, Artificial Sequence
  Antimicrobial peptide sequence
GLPWILLRWLFFRGDNGNGNGGLLRILLRWLFRFG

SEQ ID NO: 186 - protein, 35 aa, Artificial Sequence
  Antimicrobial peptide sequence
GLPWILLRWLFFRGDNGNGNGGLPWILLRWLFRRG

SEQ ID NO: 187 - protein, 35 aa, Artificial Sequence
  Antimicrobial peptide sequence
GLPWILLRWLFFRGDGNGNGNGLPWILLRWLFFRG

SEQ ID NO: 188 - protein, 35 aa, Artificial Sequence
  Antimicrobial peptide sequence
GLPWILLRWLFFRGDGNGNGNGLARILLRWLFFRG

SEQ ID NO: 189 - protein, 35 aa, Artificial Sequence
  Antimicrobial peptide sequence
GLPWILLRWLFFRGDGNGNGNGLARILLRWLFRFG

SEQ ID NO: 190 - protein, 35 aa, Artificial Sequence
  Antimicrobial peptide sequence
GLPWILLRWLFFRGDGNGNGNGLVRILLRWLFRFG

SEQ ID NO: 191 - protein, 35 aa, Artificial Sequence
  Antimicrobial peptide sequence
GLPWILLRWLFFRGDGNGNGNGLARILLRLLFFRG

SEQ ID NO: 192 - protein, 35 aa, Artificial Sequence
  Antimicrobial peptide sequence
GLPWILLRWLFFRGDGNGNGNGLARILLRLLFRFG

SEQ ID NO: 193 - protein, 35 aa, Artificial Sequence
  Antimicrobial peptide sequence
GLPWILLRWLFFRGDGNGNGNGLVRILLRLLFRFG

SEQ ID NO: 194 - protein, 35 aa, Artificial Sequence
  Antimicrobial peptide sequence
GLPWILLRWLFFRGDGNGNGNSLVRILLRLLLRFG

SEQ ID NO: 195 - protein, 35 aa, Artificial Sequence
  Antimicrobial peptide sequence
GLPWILLRWLFFRGDGNGNGNGLVRILLRLLLRYG

SEQ ID NO: 196 - protein, 35 aa, Artificial Sequence
  Antimicrobial peptide sequence
GLPWILLRWLFFRGDGNGNGNGLAWILLRWLFFRG

SEQ ID NO: 197 - protein, 35 aa, Artificial Sequence
  Antimicrobial peptide sequence
GLPWILLRWLFFRGDGNGNGNGLVRILLRWLFFRG

SEQ ID NO: 198 - protein, 35 aa, Artificial Sequence
  Antimicrobial peptide sequence
GLPWILLRWLFFRGDGNGNGNGLLRILLRWLFFRG

SEQ ID NO: 199 - protein, 35 aa, Artificial Sequence
  Antimicrobial peptide sequence
GLPWILLRWLFFRGDGNGNGNGLPWILLRWLFRFG

SEQ ID NO: 200 - protein, 35 aa, Artificial Sequence
  Antimicrobial peptide sequence
GLPWILLRWLFFRGDGNGNGNGLLRILLRWLFRFG

SEQ ID NO: 201 - protein, 35 aa, Artificial Sequence
  Antimicrobial peptide sequence
GLPWILLRWLFFRGDGNGNGNGLPWILLRWLFRRG

SEQ ID NO: 202 - protein, 35 aa, Artificial Sequence
  Antimicrobial peptide sequence
GLPWILLRWLFFRGDSGSGSGGLPWILLRWLFFRG

SEQ ID NO: 203 - protein, 35 aa, Artificial Sequence
  Antimicrobial peptide sequence
GLPWILLRWLFFRGDSGSGSGGLARILLRWLFFRG

SEQ ID NO: 204 - protein, 35 aa, Artificial Sequence
  Antimicrobial peptide sequence
GLPWILLRWLFFRGDSGSGSGGLARILLRWLFRFG

SEQ ID NO: 205 - protein, 35 aa, Artificial Sequence
  Antimicrobial peptide sequence
GLPWILLRWLFFRGDSGSGSGGLVRILLRWLFRFG

SEQ ID NO: 206 - protein, 35 aa, Artificial Sequence
  Antimicrobial peptide sequence
GLPWILLRWLFFRGDSGSGSGGLARILLRLLFFRG

SEQ ID NO: 207 - protein, 35 aa, Artificial Sequence
  Antimicrobial peptide sequence
GLPWILLRWLFFRGDSGSGSGGLARILLRLLFRFG

SEQ ID NO: 208 - protein, 35 aa, Artificial Sequence
  Antimicrobial peptide sequence
GLPWILLRWLFFRGDSGSGSGGLVRILLRLLFRFG

SEQ ID NO: 209 - protein, 35 aa, Artificial Sequence
  Antimicrobial peptide sequence
GLPWILLRWLFFRGDSGSGSGSLVRILLRLLLRFG

SEQ ID NO: 210 - protein, 35 aa, Artificial Sequence
  Antimicrobial peptide sequence
GLPWILLRWLFFRGDSGSGSGGLVRILLRLLLRYG

SEQ ID NO: 211 - protein, 35 aa, Artificial Sequence
  Antimicrobial peptide sequence
GLPWILLRWLFFRGDSGSGSGGLAWILLRWLFFRG

SEQ ID NO: 212 - protein, 35 aa, Artificial Sequence
  Antimicrobial peptide sequence
GLPWILLRWLFFRGDSGSGSGGLVRILLRWLFFRG

SEQ ID NO: 213 - protein, 35 aa, Artificial Sequence
  Antimicrobial peptide sequence
GLPWILLRWLFFRGDSGSGSGGLLRILLRWLFFRG

SEQ ID NO: 214 - protein, 35 aa, Artificial Sequence
  Antimicrobial peptide sequence
GLPWILLRWLFFRGDSGSGSGGLPWILLRWLFRFG

SEQ ID NO: 215 - protein, 35 aa, Artificial Sequence
  Antimicrobial peptide sequence
GLPWILLRWLFFRGDSGSGSGGLLRILLRWLFRFG

SEQ ID NO: 216 - protein, 35 aa, Artificial Sequence
  Antimicrobial peptide sequence
GLPWILLRWLFFRGDSGSGSGGLPWILLRWLFRRG

SEQ ID NO: 217 - protein, 35 aa, Artificial Sequence
  Antimicrobial peptide sequence
GLPWILLRWLFFRGDGSGSGSGLPWILLRWLFFRG

SEQ ID NO: 218 - protein, 35 aa, Artificial Sequence
  Antimicrobial peptide sequence
GLPWILLRWLFFRGDGSGSGSGLARILLRWLFFRG

SEQ ID NO: 219 - protein, 35 aa, Artificial Sequence
  Antimicrobial peptide sequence
GLPWILLRWLFFRGDGSGSGSGLARILLRWLFRFG

SEQ ID NO: 220 - protein, 35 aa, Artificial Sequence
  Antimicrobial peptide sequence
GLPWILLRWLFFRGDGSGSGSGLVRILLRWLFRFG

SEQ ID NO: 221 - protein, 35 aa, Artificial Sequence
  Antimicrobial peptide sequence
GLPWILLRWLFFRGDGSGSGSGLARILLRLLFFRG

SEQ ID NO: 222 - protein, 35 aa, Artificial Sequence
  Antimicrobial peptide sequence
GLPWILLRWLFFRGDGSGSGSGLARILLRLLFRFG

SEQ ID NO: 223 - protein, 35 aa, Artificial Sequence
  Antimicrobial peptide sequence
GLPWILLRWLFFRGDGSGSGSGLVRILLRLLFRFG

SEQ ID NO: 224 - protein, 35 aa, Artificial Sequence
  Antimicrobial peptide sequence
GLPWILLRWLFFRGDGSGSGSSLVRILLRLLLRFG

SEQ ID NO: 225 - protein, 35 aa, Artificial Sequence
  Antimicrobial peptide sequence
GLPWILLRWLFFRGDGSGSGSGLVRILLRLLLRYG

SEQ ID NO: 226 - protein, 35 aa, Artificial Sequence
  Antimicrobial peptide sequence
GLPWILLRWLFFRGDGSGSGSGLAWILLRWLFFRG

SEQ ID NO: 227 - protein, 35 aa, Artificial Sequence
  Antimicrobial peptide sequence
GLPWILLRWLFFRGDGSGSGSGLVRILLRWLFFRG

SEQ ID NO: 228 - protein, 35 aa, Artificial Sequence
  Antimicrobial peptide sequence
GLPWILLRWLFFRGDGSGSGSGLLRILLRWLFFRG

SEQ ID NO: 229 - protein, 35 aa, Artificial Sequence
  Antimicrobial peptide sequence
GLPWILLRWLFFRGDGSGSGSGLPWILLRWLFRFG

SEQ ID NO: 230 - protein, 35 aa, Artificial Sequence
  Antimicrobial peptide sequence
GLPWILLRWLFFRGDGSGSGSGLLRILLRWLFRFG

SEQ ID NO: 231 - protein, 35 aa, Artificial Sequence
  Antimicrobial peptide sequence
GLPWILLRWLFFRGDGSGSGSGLPWILLRWLFRRG

SEQ ID NO: 232 - protein, 35 aa, Artificial Sequence
  Antimicrobial peptide sequence
GLPWILLRWLFFRGDSNSNSNGLPWILLRWLFFRG

SEQ ID NO: 233 - protein, 35 aa, Artificial Sequence
  Antimicrobial peptide sequence
GLPWILLRWLFFRGDSNSNSNGLARILLRWLFFRG

SEQ ID NO: 234 - protein, 35 aa, Artificial Sequence
  Antimicrobial peptide sequence
GLPWILLRWLFFRGDSNSNSNGLARILLRWLFRFG

SEQ ID NO: 235 - protein, 35 aa, Artificial Sequence
  Antimicrobial peptide sequence
GLPWILLRWLFFRGDSNSNSNGLVRILLRWLFRFG

SEQ ID NO: 236 - protein, 35 aa, Artificial Sequence
  Antimicrobial peptide sequence
GLPWILLRWLFFRGDSNSNSNGLARILLRLLFFRG

SEQ ID NO: 237 - protein, 35 aa, Artificial Sequence
  Antimicrobial peptide sequence
GLPWILLRWLFFRGDSNSNSNGLARILLRLLFRFG

SEQ ID NO: 238 - protein, 35 aa, Artificial Sequence
  Antimicrobial peptide sequence
GLPWILLRWLFFRGDSNSNSNGLVRILLRLLFRFG

SEQ ID NO: 239 - protein, 35 aa, Artificial Sequence
  Antimicrobial peptide sequence
GLPWILLRWLFFRGDSNSNSNSLVRILLRLLLRFG

SEQ ID NO: 240 - protein, 35 aa, Artificial Sequence
  Antimicrobial peptide sequence
GLPWILLRWLFFRGDSNSNSNGLVRILLRLLLRYG

SEQ ID NO: 241 - protein, 35 aa, Artificial Sequence
  Antimicrobial peptide sequence
GLPWILLRWLFFRGDSNSNSNGLAWILLRWLFFRG

SEQ ID NO: 242 - protein, 35 aa, Artificial Sequence
  Antimicrobial peptide sequence
GLPWILLRWLFFRGDSNSNSNGLVRILLRWLFFRG

SEQ ID NO: 243 - protein, 35 aa, Artificial Sequence
  Antimicrobial peptide sequence
GLPWILLRWLFFRGDSNSNSNGLLRILLRWLFFRG

SEQ ID NO: 244 - protein, 35 aa, Artificial Sequence
  Antimicrobial peptide sequence
GLPWILLRWLFFRGDSNSNSNGLPWILLRWLFRFG

SEQ ID NO: 245 - protein, 35 aa, Artificial Sequence
  Antimicrobial peptide sequence
GLPWILLRWLFFRGDSNSNSNGLLRILLRWLFRFG

SEQ ID NO: 246 - protein, 35 aa, Artificial Sequence
  Antimicrobial peptide sequence
GLPWILLRWLFFRGDSNSNSNGLPWILLRWLFRRG

SEQ ID NO: 247 - protein, 35 aa, Artificial Sequence
  Antimicrobial peptide sequence
GLPWILLRWLFFRGDNSNSNSGLPWILLRWLFFRG

SEQ ID NO: 248 - protein, 35 aa, Artificial Sequence
  Antimicrobial peptide sequence
GLPWILLRWLFFRGDNSNSNSGLARILLRWLFFRG

SEQ ID NO: 249 - protein, 35 aa, Artificial Sequence
  Antimicrobial peptide sequence
GLPWILLRWLFFRGDNSNSNSGLARILLRWLFRFG

SEQ ID NO: 250 - protein, 35 aa, Artificial Sequence
  Antimicrobial peptide sequence
GLPWILLRWLFFRGDNSNSNSGLVRILLRWLFRFG

SEQ ID NO: 251 - protein, 35 aa, Artificial Sequence
  Antimicrobial peptide sequence
GLPWILLRWLFFRGDNSNSNSGLARILLRLLFFRG

SEQ ID NO: 252 - protein, 35 aa, Artificial Sequence
  Antimicrobial peptide sequence
GLPWILLRWLFFRGDNSNSNSGLARILLRLLFRFG

SEQ ID NO: 253 - protein, 35 aa, Artificial Sequence
  Antimicrobial peptide sequence
GLPWILLRWLFFRGDNSNSNSGLVRILLRLLFRFG

SEQ ID NO: 254 - protein, 35 aa, Artificial Sequence
  Antimicrobial peptide sequence
GLPWILLRWLFFRGDNSNSNSSLVRILLRLLLRFG

SEQ ID NO: 255 - protein, 35 aa, Artificial Sequence
  Antimicrobial peptide sequence
GLPWILLRWLFFRGDNSNSNSGLVRILLRLLLRYG

SEQ ID NO: 256 - protein, 35 aa, Artificial Sequence
  Antimicrobial peptide sequence
GLPWILLRWLFFRGDNSNSNSGLAWILLRWLFFRG

SEQ ID NO: 257 - protein, 35 aa, Artificial Sequence
  Antimicrobial peptide sequence
GLPWILLRWLFFRGDNSNSNSGLVRILLRWLFFRG

SEQ ID NO: 258 - protein, 35 aa, Artificial Sequence
  Antimicrobial peptide sequence
GLPWILLRWLFFRGDNSNSNSGLLRILLRWLFFRG

SEQ ID NO: 259 - protein, 35 aa, Artificial Sequence
  Antimicrobial peptide sequence
GLPWILLRWLFFRGDNSNSNSGLPWILLRWLFRFG

SEQ ID NO: 260 - protein, 35 aa, Artificial Sequence
  Antimicrobial peptide sequence
GLPWILLRWLFFRGDNSNSNSGLLRILLRWLFRFG

SEQ ID NO: 261 - protein, 35 aa, Artificial Sequence
  Antimicrobial peptide sequence
GLPWILLRWLFFRGDNSNSNSGLPWILLRWLFRRG

SEQ ID NO: 262 - protein, 35 aa, Artificial Sequence
  Antimicrobial peptide sequence
GLPWILLRWLFFRGDHGHGHGGLPWILLRWLFFRG

SEQ ID NO: 263 - protein, 35 aa, Artificial Sequence
  Antimicrobial peptide sequence
GLPWILLRWLFFRGDHGHGHGGLARILLRWLFFRG

SEQ ID NO: 264 - protein, 35 aa, Artificial Sequence
  Antimicrobial peptide sequence
GLPWILLRWLFFRGDHGHGHGGLARILLRWLFRFG

SEQ ID NO: 265 - protein, 35 aa, Artificial Sequence
  Antimicrobial peptide sequence
GLPWILLRWLFFRGDHGHGHGGLVRILLRWLFRFG

SEQ ID NO: 266 - protein, 35 aa, Artificial Sequence
  Antimicrobial peptide sequence
GLPWILLRWLFFRGDHGHGHGGLARILLRLLFFRG

SEQ ID NO: 267 - protein, 35 aa, Artificial Sequence
  Antimicrobial peptide sequence
GLPWILLRWLFFRGDHGHGHGGLARILLRLLFRFG

SEQ ID NO: 268 - protein, 35 aa, Artificial Sequence
  Antimicrobial peptide sequence
GLPWILLRWLFFRGDHGHGHGGLVRILLRLLFRFG

SEQ ID NO: 269 - protein, 35 aa, Artificial Sequence
  Antimicrobial peptide sequence
GLPWILLRWLFFRGDHGHGHGSLVRILLRLLLRFG

SEQ ID NO: 270 - protein, 35 aa, Artificial Sequence
  Antimicrobial peptide sequence
GLPWILLRWLFFRGDHGHGHGGLVRILLRLLLRYG

SEQ ID NO: 271 - protein, 35 aa, Artificial Sequence
  Antimicrobial peptide sequence
GLPWILLRWLFFRGDHGHGHGGLAWILLRWLFFRG

SEQ ID NO: 272 - protein, 35 aa, Artificial Sequence
  Antimicrobial peptide sequence
GLPWILLRWLFFRGDHGHGHGGLVRILLRWLFFRG

SEQ ID NO: 273 - protein, 35 aa, Artificial Sequence
  Antimicrobial peptide sequence
GLPWILLRWLFFRGDHGHGHGGLLRILLRWLFFRG

SEQ ID NO: 274 - protein, 35 aa, Artificial Sequence
  Antimicrobial peptide sequence
GLPWILLRWLFFRGDHGHGHGGLPWILLRWLFRFG

SEQ ID NO: 275 - protein, 35 aa, Artificial Sequence
  Antimicrobial peptide sequence
GLPWILLRWLFFRGDHGHGHGGLLRILLRWLFRFG

SEQ ID NO: 276 - protein, 35 aa, Artificial Sequence
  Antimicrobial peptide sequence
GLPWILLRWLFFRGDHGHGHGGLPWILLRWLFRRG

SEQ ID NO: 277 - protein, 35 aa, Artificial Sequence
  Antimicrobial peptide sequence
GLPWILLRWLFFRGDGHGHGHGLPWILLRWLFFRG

SEQ ID NO: 278 - protein, 35 aa, Artificial Sequence
  Antimicrobial peptide sequence
GLPWILLRWLFFRGDGHGHGHGLARILLRWLFFRG

SEQ ID NO: 279 - protein, 35 aa, Artificial Sequence
  Antimicrobial peptide sequence
GLPWILLRWLFFRGDGHGHGHGLARILLRWLFRFG

SEQ ID NO: 280 - protein, 35 aa, Artificial Sequence
  Antimicrobial peptide sequence
GLPWILLRWLFFRGDGHGHGHGLVRILLRWLFRFG

SEQ ID NO: 281 - protein, 35 aa, Artificial Sequence
  Antimicrobial peptide sequence
GLPWILLRWLFFRGDGHGHGHGLARILLRLLFFRG

SEQ ID NO: 282 - protein, 35 aa, Artificial Sequence
  Antimicrobial peptide sequence
GLPWILLRWLFFRGDGHGHGHGLARILLRLLFRFG

SEQ ID NO: 283 - protein, 35 aa, Artificial Sequence
  Antimicrobial peptide sequence
GLPWILLRWLFFRGDGHGHGHGLVRILLRLLFRFG

SEQ ID NO: 284 - protein, 35 aa, Artificial Sequence
  Antimicrobial peptide sequence
GLPWILLRWLFFRGDGHGHGHSLVRILLRLLLRFG

SEQ ID NO: 285 - protein, 35 aa, Artificial Sequence
  Antimicrobial peptide sequence
GLPWILLRWLFFRGDGHGHGHGLVRILLRLLLRYG

SEQ ID NO: 286 - protein, 35 aa, Artificial Sequence
  Antimicrobial peptide sequence
GLPWILLRWLFFRGDGHGHGHGLAWILLRWLFFRG

SEQ ID NO: 287 - protein, 35 aa, Artificial Sequence
  Antimicrobial peptide sequence
GLPWILLRWLFFRGDGHGHGHGLVRILLRWLFFRG

SEQ ID NO: 288 - protein, 35 aa, Artificial Sequence
  Antimicrobial peptide sequence
GLPWILLRWLFFRGDGHGHGHGLLRILLRWLFFRG

SEQ ID NO: 289 - protein, 35 aa, Artificial Sequence
  Antimicrobial peptide sequence
GLPWILLRWLFFRGDGHGHGHGLPWILLRWLFRFG

SEQ ID NO: 290 - protein, 35 aa, Artificial Sequence
  Antimicrobial peptide sequence
GLPWILLRWLFFRGDGHGHGHGLLRILLRWLFRFG

SEQ ID NO: 291 - protein, 35 aa, Artificial Sequence
  Antimicrobial peptide sequence
GLPWILLRWLFFRGDGHGHGHGLPWILLRWLFRRG

SEQ ID NO: 292 - protein, 35 aa, Artificial Sequence
  Antimicrobial peptide sequence
GLPWILLRWLFFRGDHNHNHNGLPWILLRWLFFRG

SEQ ID NO: 293 - protein, 35 aa, Artificial Sequence
  Antimicrobial peptide sequence
GLPWILLRWLFFRGDHNHNHNGLARILLRWLFFRG

SEQ ID NO: 294 - protein, 35 aa, Artificial Sequence
  Antimicrobial peptide sequence
GLPWILLRWLFFRGDHNHNHNGLARILLRWLFRFG

SEQ ID NO: 295 - protein, 35 aa, Artificial Sequence
  Antimicrobial peptide sequence
GLPWILLRWLFFRGDHNHNHNGLVRILLRWLFRFG

SEQ ID NO: 296 - protein, 35 aa, Artificial Sequence
  Antimicrobial peptide sequence
GLPWILLRWLFFRGDHNHNHNGLARILLRLLFFRG

SEQ ID NO: 297 - protein, 35 aa, Artificial Sequence
  Antimicrobial peptide sequence
GLPWILLRWLFFRGDHNHNHNGLARILLRLLFRFG

SEQ ID NO: 298 - protein, 35 aa, Artificial Sequence
  Antimicrobial peptide sequence
GLPWILLRWLFFRGDHNHNHNGLVRILLRLLFRFG

SEQ ID NO: 299 - protein, 35 aa, Artificial Sequence
  Antimicrobial peptide sequence
GLPWILLRWLFFRGDHNHNHNSLVRILLRLLLRFG

SEQ ID NO: 300 - protein, 35 aa, Artificial Sequence
  Antimicrobial peptide sequence
GLPWILLRWLFFRGDHNHNHNGLVRILLRLLLRYG

SEQ ID NO: 301 - protein, 35 aa, Artificial Sequence
  Antimicrobial peptide sequence
GLPWILLRWLFFRGDHNHNHNGLAWILLRWLFFRG

SEQ ID NO: 302 - protein, 35 aa, Artificial Sequence
  Antimicrobial peptide sequence
GLPWILLRWLFFRGDHNHNHNGLVRILLRWLFFRG

SEQ ID NO: 303 - protein, 35 aa, Artificial Sequence
  Antimicrobial peptide sequence
GLPWILLRWLFFRGDHNHNHNGLLRILLRWLFFRG

SEQ ID NO: 304 - protein, 35 aa, Artificial Sequence
  Antimicrobial peptide sequence
GLPWILLRWLFFRGDHNHNHNGLPWILLRWLFRFG

SEQ ID NO: 305 - protein, 35 aa, Artificial Sequence
  Antimicrobial peptide sequence
GLPWILLRWLFFRGDHNHNHNGLLRILLRWLFRFG

SEQ ID NO: 306 - protein, 35 aa, Artificial Sequence
  Antimicrobial peptide sequence
GLPWILLRWLFFRGDHNHNHNGLPWILLRWLFRRG

SEQ ID NO: 307 - protein, 35 aa, Artificial Sequence
  Antimicrobial peptide sequence
GLPWILLRWLFFRGDNHNHNHGLPWILLRWLFFRG

SEQ ID NO: 308 - protein, 35 aa, Artificial Sequence
  Antimicrobial peptide sequence
GLPWILLRWLFFRGDNHNHNHGLARILLRWLFFRG

SEQ ID NO: 309 - protein, 35 aa, Artificial Sequence
  Antimicrobial peptide sequence
GLPWILLRWLFFRGDNHNHNHGLARILLRWLFRFG

SEQ ID NO: 310 - protein, 35 aa, Artificial Sequence
  Antimicrobial peptide sequence
GLPWILLRWLFFRGDNHNHNHGLVRILLRWLFRFG

SEQ ID NO: 311 - protein, 35 aa, Artificial Sequence
  Antimicrobial peptide sequence
GLPWILLRWLFFRGDNHNHNHGLARILLRLLFFRG

SEQ ID NO: 312 - protein, 35 aa, Artificial Sequence
  Antimicrobial peptide sequence
GLPWILLRWLFFRGDNHNHNHGLARILLRLLFRFG

SEQ ID NO: 313 - protein, 35 aa, Artificial Sequence
  Antimicrobial peptide sequence
GLPWILLRWLFFRGDNHNHNHGLVRILLRLLFRFG

SEQ ID NO: 314 - protein, 35 aa, Artificial Sequence
  Antimicrobial peptide sequence
GLPWILLRWLFFRGDNHNHNHSLVRILLRLLLRFG

SEQ ID NO: 315 - protein, 35 aa, Artificial Sequence
  Antimicrobial peptide sequence
GLPWILLRWLFFRGDNHNHNHGLVRILLRLLLRYG

SEQ ID NO: 316 - protein, 35 aa, Artificial Sequence
  Antimicrobial peptide sequence
GLPWILLRWLFFRGDNHNHNHGLAWILLRWLFFRG

SEQ ID NO: 317 - protein, 35 aa, Artificial Sequence
  Antimicrobial peptide sequence
GLPWILLRWLFFRGDNHNHNHGLVRILLRWLFFRG

SEQ ID NO: 318 - protein, 35 aa, Artificial Sequence
  Antimicrobial peptide sequence
GLPWILLRWLFFRGDNHNHNHGLLRILLRWLFFRG

SEQ ID NO: 319 - protein, 35 aa, Artificial Sequence
  Antimicrobial peptide sequence
GLPWILLRWLFFRGDNHNHNHGLPWILLRWLFRFG

SEQ ID NO: 320 - protein, 35 aa, Artificial Sequence
  Antimicrobial peptide sequence
GLPWILLRWLFFRGDNHNHNHGLLRILLRWLFRFG

SEQ ID NO: 321 - protein, 35 aa, Artificial Sequence
  Antimicrobial peptide sequence
GLPWILLRWLFFRGDNHNHNHGLPWILLRWLFRRG

SEQ ID NO: 322 - protein, 33 aa, Artificial Sequence
  Antimicrobial peptide sequence
GLARILLRWLFFRGDGGGGGLPWILLRWLFFRG

SEQ ID NO: 323 - protein, 33 aa, Artificial Sequence
  Antimicrobial peptide sequence
GLARILLRWLFFRGDGGGGGLARILLRWLFFRG

SEQ ID NO: 324 - protein, 33 aa, Artificial Sequence
  Antimicrobial peptide sequence
GLARILLRWLFFRGDGGGGGLARILLRWLFRFG

SEQ ID NO: 325 - protein, 33 aa, Artificial Sequence
  Antimicrobial peptide sequence
GLARILLRWLFFRGDGGGGGLVRILLRWLFRFG

SEQ ID NO: 326 - protein, 33 aa, Artificial Sequence
  Antimicrobial peptide sequence
GLARILLRWLFFRGDGGGGGLARILLRLLFFRG

SEQ ID NO: 327 - protein, 33 aa, Artificial Sequence
  Antimicrobial peptide sequence
GLARILLRWLFFRGDGGGGGLARILLRLLFRFG

SEQ ID NO: 328 - protein, 33 aa, Artificial Sequence
  Antimicrobial peptide sequence
GLARILLRWLFFRGDGGGGGLVRILLRLLFRFG

SEQ ID NO: 329 - protein, 33 aa, Artificial Sequence
  Antimicrobial peptide sequence
GLARILLRWLFFRGDGGGGSLVRILLRLLLRFG

SEQ ID NO: 330 - protein, 33 aa, Artificial Sequence
  Antimicrobial peptide sequence
GLARILLRWLFFRGDGGGGGLVRILLRLLLRYG

SEQ ID NO: 331 - protein, 33 aa, Artificial Sequence
  Antimicrobial peptide sequence
GLARILLRWLFFRGDGGGGGLAWILLRWLFFRG

SEQ ID NO: 332 - protein, 33 aa, Artificial Sequence
  Antimicrobial peptide sequence
GLARILLRWLFFRGDGGGGGLVRILLRWLFFRG

SEQ ID NO: 333 - protein, 33 aa, Artificial Sequence
  Antimicrobial peptide sequence
GLARILLRWLFFRGDGGGGGLLRILLRWLFFRG

SEQ ID NO: 334 - protein, 33 aa, Artificial Sequence
  Antimicrobial peptide sequence
GLARILLRWLFFRGDGGGGGLPWILLRWLFRFG

SEQ ID NO: 335 - protein, 33 aa, Artificial Sequence
  Antimicrobial peptide sequence
GLARILLRWLFFRGDGGGGGLLRILLRWLFRFG

SEQ ID NO: 336 - protein, 33 aa, Artificial Sequence
  Antimicrobial peptide sequence
GLARILLRWLFFRGDGGGGGLPWILLRWLFRRG

SEQ ID NO: 337 - protein, 34 aa, Artificial Sequence
  Antimicrobial peptide sequence
GLARILLRWLFFRGDGGGGGGLPWILLRWLFFRG

SEQ ID NO: 338 - protein, 34 aa, Artificial Sequence; identical to SEQ ID NO: 46
  Antimicrobial peptide sequence

SEQ ID NO: 339 - protein, 34 aa, Artificial Sequence
  Antimicrobial peptide sequence
GLARILLRWLFFRGDGGGGGGLARILLRWLFRFG

SEQ ID NO: 340 - protein, 34 aa, Artificial Sequence
  Antimicrobial peptide sequence
GLARILLRWLFFRGDGGGGGGLVRILLRWLFRFG

SEQ ID NO: 341 - protein, 34 aa, Artificial Sequence
  Antimicrobial peptide sequence
GLARILLRWLFFRGDGGGGGGLARILLRLLFFRG

SEQ ID NO: 342 - protein, 34 aa, Artificial Sequence
  Antimicrobial peptide sequence
GLARILLRWLFFRGDGGGGGGLARILLRLLFRFG

SEQ ID NO: 343 - protein, 34 aa, Artificial Sequence
  Antimicrobial peptide sequence
GLARILLRWLFFRGDGGGGGGLVRILLRLLFRFG

SEQ ID NO: 344 - protein, 34 aa, Artificial Sequence
  Antimicrobial peptide sequence
GLARILLRWLFFRGDGGGGGSLVRILLRLLLRFG

SEQ ID NO: 345 - protein, 34 aa, Artificial Sequence
  Antimicrobial peptide sequence
GLARILLRWLFFRGDGGGGGGLVRILLRLLLRYG

SEQ ID NO: 346 - protein, 34 aa, Artificial Sequence
  Antimicrobial peptide sequence
GLARILLRWLFFRGDGGGGGGLAWILLRWLFFRG

SEQ ID NO: 347 - protein, 34 aa, Artificial Sequence
  Antimicrobial peptide sequence
GLARILLRWLFFRGDGGGGGGLVRILLRWLFFRG

SEQ ID NO: 348 - protein, 34 aa, Artificial Sequence
  Antimicrobial peptide sequence
GLARILLRWLFFRGDGGGGGGLLRILLRWLFFRG

SEQ ID NO: 349 - protein, 34 aa, Artificial Sequence
  Antimicrobial peptide sequence
GLARILLRWLFFRGDGGGGGGLPWILLRWLFRFG

SEQ ID NO: 350 - protein, 34 aa, Artificial Sequence
  Antimicrobial peptide sequence
GLARILLRWLFFRGDGGGGGGLLRILLRWLFRFG

SEQ ID NO: 351 - protein, 34 aa, Artificial Sequence
  Antimicrobial peptide sequence
GLARILLRWLFFRGDGGGGGGLPWILLRWLFRRG

SEQ ID NO: 352 - protein, 35 aa, Artificial Sequence
  Antimicrobial peptide sequence
GLARILLRWLFFRGDGGGGGGGLPWILLRWLFFRG

SEQ ID NO: 353 - protein, 35 aa, Artificial Sequence; identical to SEQ ID NO: 40
  Antimicrobial peptide sequence

SEQ ID NO: 354 - protein, 35 aa, Artificial Sequence
  Antimicrobial peptide sequence
GLARILLRWLFFRGDGGGGGGGLARILLRWLFRFG

SEQ ID NO: 355 - protein, 35 aa, Artificial Sequence
  Antimicrobial peptide sequence
GLARILLRWLFFRGDGGGGGGGLVRILLRWLFRFG

SEQ ID NO: 356 - protein, 35 aa, Artificial Sequence
  Antimicrobial peptide sequence
GLARILLRWLFFRGDGGGGGGGLARILLRLLFFRG

SEQ ID NO: 357 - protein, 35 aa, Artificial Sequence
  Antimicrobial peptide sequence
GLARILLRWLFFRGDGGGGGGGLARILLRLLFRFG

SEQ ID NO: 358 - protein, 35 aa, Artificial Sequence
  Antimicrobial peptide sequence
GLARILLRWLFFRGDGGGGGGGLVRILLRLLFRFG

SEQ ID NO: 359 - protein, 35 aa, Artificial Sequence
  Antimicrobial peptide sequence
GLARILLRWLFFRGDGGGGGGSLVRILLRLLLRFG

SEQ ID NO: 360 - protein, 35 aa, Artificial Sequence
  Antimicrobial peptide sequence
GLARILLRWLFFRGDGGGGGGGLVRILLRLLLRYG

SEQ ID NO: 361 - protein, 35 aa, Artificial Sequence
  Antimicrobial peptide sequence
GLARILLRWLFFRGDGGGGGGGLAWILLRWLFFRG

SEQ ID NO: 362 - protein, 35 aa, Artificial Sequence
  Antimicrobial peptide sequence
GLARILLRWLFFRGDGGGGGGGLVRILLRWLFFRG

SEQ ID NO: 363 - protein, 35 aa, Artificial Sequence
  Antimicrobial peptide sequence
GLARILLRWLFFRGDGGGGGGGLLRILLRWLFFRG

SEQ ID NO: 364 - protein, 35 aa, Artificial Sequence
  Antimicrobial peptide sequence
GLARILLRWLFFRGDGGGGGGGLPWILLRWLFRFG

SEQ ID NO: 365 - protein, 35 aa, Artificial Sequence
  Antimicrobial peptide sequence
GLARILLRWLFFRGDGGGGGGGLLRILLRWLFRFG

SEQ ID NO: 366 - protein, 35 aa, Artificial Sequence
  Antimicrobial peptide sequence
GLARILLRWLFFRGDGGGGGGGLPWILLRWLFRRG

SEQ ID NO: 367 - protein, 36 aa, Artificial Sequence
  Antimicrobial peptide sequence
GLARILLRWLFFRGDGGGGGGGGLPWILLRWLFFRG

SEQ ID NO: 368 - protein, 36 aa, Artificial Sequence
  Antimicrobial peptide sequence
GLARILLRWLFFRGDGGGGGGGGLARILLRWLFFRG

SEQ ID NO: 369 - protein, 36 aa, Artificial Sequence
  Antimicrobial peptide sequence
GLARILLRWLFFRGDGGGGGGGGLARILLRWLFRFG

SEQ ID NO: 370 - protein, 36 aa, Artificial Sequence
  Antimicrobial peptide sequence
GLARILLRWLFFRGDGGGGGGGGLVRILLRWLFRFG

SEQ ID NO: 371 - protein, 36 aa, Artificial Sequence
  Antimicrobial peptide sequence
GLARILLRWLFFRGDGGGGGGGGLARILLRLLFFRG

SEQ ID NO: 372 - protein, 36 aa, Artificial Sequence
  Antimicrobial peptide sequence
GLARILLRWLFFRGDGGGGGGGGLARILLRLLFRFG

SEQ ID NO: 373 - protein, 36 aa, Artificial Sequence
  Antimicrobial peptide sequence
GLARILLRWLFFRGDGGGGGGGGLVRILLRLLFRFG

SEQ ID NO: 374 - protein, 36 aa, Artificial Sequence
  Antimicrobial peptide sequence
GLARILLRWLFFRGDGGGGGGGSLVRILLRLLLRFG

SEQ ID NO: 375 - protein, 36 aa, Artificial Sequence
  Antimicrobial peptide sequence
GLARILLRWLFFRGDGGGGGGGGLVRILLRLLLRYG

SEQ ID NO: 376 - protein, 36 aa, Artificial Sequence
  Antimicrobial peptide sequence
GLARILLRWLFFRGDGGGGGGGGLAWILLRWLFFRG

SEQ ID NO: 377 - protein, 36 aa, Artificial Sequence
  Antimicrobial peptide sequence
GLARILLRWLFFRGDGGGGGGGGLVRILLRWLFFRG

SEQ ID NO: 378 - protein, 36 aa, Artificial Sequence
  Antimicrobial peptide sequence
GLARILLRWLFFRGDGGGGGGGGLLRILLRWLFFRG

SEQ ID NO: 379 - protein, 36 aa, Artificial Sequence
  Antimicrobial peptide sequence
GLARILLRWLFFRGDGGGGGGGGLPWILLRWLFRFG

SEQ ID NO: 380 - protein, 36 aa, Artificial Sequence
  Antimicrobial peptide sequence
GLARILLRWLFFRGDGGGGGGGGLLRILLRWLFRFG

SEQ ID NO: 381 - protein, 36 aa, Artificial Sequence
  Antimicrobial peptide sequence
GLARILLRWLFFRGDGGGGGGGGLPWILLRWLFRRG

SEQ ID NO: 382 - protein, 33 aa, Artificial Sequence
  Antimicrobial peptide sequence
GLARILLRWLFFRGDNNNNGLPWILLRWLFFRG

SEQ ID NO: 383 - protein, 33 aa, Artificial Sequence
  Antimicrobial peptide sequence
GLARILLRWLFFRGDNNNNGLARILLRWLFFRG

SEQ ID NO: 384 - protein, 33 aa, Artificial Sequence
  Antimicrobial peptide sequence
GLARILLRWLFFRGDNNNNGLARILLRWLFRFG

SEQ ID NO: 385 - protein, 33 aa, Artificial Sequence
  Antimicrobial peptide sequence
GLARILLRWLFFRGDNNNNGLVRILLRWLFRFG

SEQ ID NO: 386 - protein, 33 aa, Artificial Sequence
  Antimicrobial peptide sequence
GLARILLRWLFFRGDNNNNGLARILLRLLFFRG

SEQ ID NO: 387 - protein, 33 aa, Artificial Sequence
  Antimicrobial peptide sequence
GLARILLRWLFFRGDNNNNGLARILLRLLFRFG

SEQ ID NO: 388 - protein, 33 aa, Artificial Sequence
  Antimicrobial peptide sequence
GLARILLRWLFFRGDNNNNGLVRILLRLLFRFG

SEQ ID NO: 389 - protein, 33 aa, Artificial Sequence
  Antimicrobial peptide sequence
GLARILLRWLFFRGDNNNNSLVRILLRLLLRFG

SEQ ID NO: 390 - protein, 33 aa, Artificial Sequence
  Antimicrobial peptide sequence
GLARILLRWLFFRGDNNNNGLVRILLRLLLRYG

SEQ ID NO: 391 - protein, 33 aa, Artificial Sequence
  Antimicrobial peptide sequence
GLARILLRWLFFRGDNNNNGLAWILLRWLFFRG

SEQ ID NO: 392 - protein, 33 aa, Artificial Sequence
  Antimicrobial peptide sequence
GLARILLRWLFFRGDNNNNGLVRILLRWLFFRG

SEQ ID NO: 393 - protein, 33 aa, Artificial Sequence
  Antimicrobial peptide sequence
GLARILLRWLFFRGDNNNNGLLRILLRWLFFRG

SEQ ID NO: 394 - protein, 33 aa, Artificial Sequence
  Antimicrobial peptide sequence
GLARILLRWLFFRGDNNNNGLPWILLRWLFRFG

SEQ ID NO: 395 - protein, 33 aa, Artificial Sequence
  Antimicrobial peptide sequence
GLARILLRWLFFRGDNNNNGLLRILLRWLFRFG

SEQ ID NO: 396 - protein, 33 aa, Artificial Sequence
  Antimicrobial peptide sequence
GLARILLRWLFFRGDNNNNGLPWILLRWLFRRG

SEQ ID NO: 397 - protein, 34 aa, Artificial Sequence
  Antimicrobial peptide sequence
GLARILLRWLFFRGDNNNNNGLPWILLRWLFFRG

SEQ ID NO: 398 - protein, 34 aa, Artificial Sequence; identical to SEQ ID NO: 47
  Antimicrobial peptide sequence

SEQ ID NO: 399 - protein, 34 aa, Artificial Sequence
  Antimicrobial peptide sequence
GLARILLRWLFFRGDNNNNNGLARILLRWLFRFG

SEQ ID NO: 400 - protein, 34 aa, Artificial Sequence
  Antimicrobial peptide sequence
GLARILLRWLFFRGDNNNNNGLVRILLRWLFRFG

SEQ ID NO: 401 - protein, 34 aa, Artificial Sequence
  Antimicrobial peptide sequence
GLARILLRWLFFRGDNNNNNGLARILLRLLFFRG

SEQ ID NO: 402 - protein, 34 aa, Artificial Sequence
  Antimicrobial peptide sequence
GLARILLRWLFFRGDNNNNNGLARILLRLLFRFG

SEQ ID NO: 403 - protein, 34 aa, Artificial Sequence
  Antimicrobial peptide sequence
GLARILLRWLFFRGDNNNNNGLVRILLRLLFRFG

SEQ ID NO: 404 - protein, 34 aa, Artificial Sequence
  Antimicrobial peptide sequence
GLARILLRWLFFRGDNNNNNSLVRILLRLLLRFG

SEQ ID NO: 405 - protein, 34 aa, Artificial Sequence
  Antimicrobial peptide sequence
GLARILLRWLFFRGDNNNNNGLVRILLRLLLRYG

SEQ ID NO: 406 - protein, 34 aa, Artificial Sequence
  Antimicrobial peptide sequence
GLARILLRWLFFRGDNNNNNGLAWILLRWLFFRG

SEQ ID NO: 407 - protein, 34 aa, Artificial Sequence
  Antimicrobial peptide sequence
GLARILLRWLFFRGDNNNNNGLVRILLRWLFFRG

SEQ ID NO: 408 - protein, 34 aa, Artificial Sequence
  Antimicrobial peptide sequence
GLARILLRWLFFRGDNNNNNGLLRILLRWLFFRG

SEQ ID NO: 409 - protein, 34 aa, Artificial Sequence
  Antimicrobial peptide sequence
GLARILLRWLFFRGDNNNNNGLPWILLRWLFRFG

SEQ ID NO: 410 - protein, 34 aa, Artificial Sequence
  Antimicrobial peptide sequence
GLARILLRWLFFRGDNNNNNGLLRILLRWLFRFG

SEQ ID NO: 411 - protein, 34 aa, Artificial Sequence
  Antimicrobial peptide sequence
GLARILLRWLFFRGDNNNNNGLPWILLRWLFRRG

SEQ ID NO: 412 - protein, 35 aa, Artificial Sequence
  Antimicrobial peptide sequence
GLARILLRWLFFRGDNNNNNNGLPWILLRWLFFRG

SEQ ID NO: 413 - protein, 35 aa, Artificial Sequence; identical to SEQ ID NO: 41
  Antimicrobial peptide sequence

SEQ ID NO: 414 - protein, 35 aa, Artificial Sequence
  Antimicrobial peptide sequence
GLARILLRWLFFRGDNNNNNNGLARILLRWLFRFG

SEQ ID NO: 415 - protein, 35 aa, Artificial Sequence
  Antimicrobial peptide sequence
GLARILLRWLFFRGDNNNNNNGLVRILLRWLFRFG

SEQ ID NO: 416 - protein, 35 aa, Artificial Sequence
  Antimicrobial peptide sequence
GLARILLRWLFFRGDNNNNNNGLARILLRLLFFRG

SEQ ID NO: 417 - protein, 35 aa, Artificial Sequence
  Antimicrobial peptide sequence
GLARILLRWLFFRGDNNNNNNGLARILLRLLFRFG

SEQ ID NO: 418 - protein, 35 aa, Artificial Sequence
  Antimicrobial peptide sequence
GLARILLRWLFFRGDNNNNNNGLVRILLRLLFRFG

SEQ ID NO: 419 - protein, 35 aa, Artificial Sequence
  Antimicrobial peptide sequence
GLARILLRWLFFRGDNNNNNNSLVRILLRLLLRFG

SEQ ID NO: 420 - protein, 35 aa, Artificial Sequence
  Antimicrobial peptide sequence
GLARILLRWLFFRGDNNNNNNGLVRILLRLLLRYG

SEQ ID NO: 421 - protein, 35 aa, Artificial Sequence
  Antimicrobial peptide sequence
GLARILLRWLFFRGDNNNNNNGLAWILLRWLFFRG

SEQ ID NO: 422 - protein, 35 aa, Artificial Sequence
  Antimicrobial peptide sequence
GLARILLRWLFFRGDNNNNNNGLVRILLRWLFFRG

SEQ ID NO: 423 - protein, 35 aa, Artificial Sequence
  Antimicrobial peptide sequence
GLARILLRWLFFRGDNNNNNNGLLRILLRWLFFRG

SEQ ID NO: 424 - protein, 35 aa, Artificial Sequence
  Antimicrobial peptide sequence
GLARILLRWLFFRGDNNNNNNGLPWILLRWLFRFG

SEQ ID NO: 425 - protein, 35 aa, Artificial Sequence
  Antimicrobial peptide sequence
GLARILLRWLFFRGDNNNNNNGLLRILLRWLFRFG

SEQ ID NO: 426 - protein, 35 aa, Artificial Sequence
  Antimicrobial peptide sequence
GLARILLRWLFFRGDNNNNNNGLPWILLRWLFRRG

SEQ ID NO: 427 - protein, 36 aa, Artificial Sequence
  Antimicrobial peptide sequence
GLARILLRWLFFRGDNNNNNNNGLPWILLRWLFFRG

SEQ ID NO: 428 - protein, 36 aa, Artificial Sequence
  Antimicrobial peptide sequence
GLARILLRWLFFRGDNNNNNNNGLARILLRWLFFRG

SEQ ID NO: 429 - protein, 36 aa, Artificial Sequence
  Antimicrobial peptide sequence
GLARILLRWLFFRGDNNNNNNNGLARILLRWLFRFG

SEQ ID NO: 430 - protein, 36 aa, Artificial Sequence
  Antimicrobial peptide sequence
GLARILLRWLFFRGDNNNNNNNGLVRILLRWLFRFG

SEQ ID NO: 431 - protein, 36 aa, Artificial Sequence
  Antimicrobial peptide sequence
GLARILLRWLFFRGDNNNNNNNGLARILLRLLFFRG

SEQ ID NO: 432 - protein, 36 aa, Artificial Sequence
  Antimicrobial peptide sequence
GLARILLRWLFFRGDNNNNNNNGLARILLRLLFRFG

SEQ ID NO: 433 - protein, 36 aa, Artificial Sequence
  Antimicrobial peptide sequence
GLARILLRWLFFRGDNNNNNNNGLVRILLRLLFRFG

SEQ ID NO: 434 - protein, 36 aa, Artificial Sequence
  Antimicrobial peptide sequence
GLARILLRWLFFRGDNNNNNNNSLVRILLRLLLRFG

SEQ ID NO: 435 - protein, 36 aa, Artificial Sequence
  Antimicrobial peptide sequence
GLARILLRWLFFRGDNNNNNNNGLVRILLRLLLRYG

SEQ ID NO: 436 - protein, 36 aa, Artificial Sequence
  Antimicrobial peptide sequence
GLARILLRWLFFRGDNNNNNNNGLAWILLRWLFFRG

SEQ ID NO: 437 - protein, 36 aa, Artificial Sequence
  Antimicrobial peptide sequence
GLARILLRWLFFRGDNNNNNNNGLVRILLRWLFFRG

SEQ ID NO: 438 - protein, 36 aa, Artificial Sequence
  Antimicrobial peptide sequence
GLARILLRWLFFRGDNNNNNNNGLLRILLRWLFFRG

SEQ ID NO: 439 - protein, 36 aa, Artificial Sequence
  Antimicrobial peptide sequence
GLARILLRWLFFRGDNNNNNNNGLPWILLRWLFRFG

SEQ ID NO: 440 - protein, 36 aa, Artificial Sequence
  Antimicrobial peptide sequence
GLARILLRWLFFRGDNNNNNNNGLLRILLRWLFRFG

SEQ ID NO: 441 - protein, 36 aa, Artificial Sequence
  Antimicrobial peptide sequence
GLARILLRWLFFRGDNNNNNNNGLPWILLRWLFRRG

SEQ ID NO: 442 - protein, 35 aa, Artificial Sequence
  Antimicrobial peptide sequence
GLARILLRWLFFRGDNGNGNGGLPWILLRWLFFRG

SEQ ID NO: 443 - protein, 35 aa, Artificial Sequence
  Antimicrobial peptide sequence
GLARILLRWLFFRGDNGNGNGGLARILLRWLFFRG

SEQ ID NO: 444 - protein, 35 aa, Artificial Sequence
  Antimicrobial peptide sequence
GLARILLRWLFFRGDNGNGNGGLARILLRWLFRFG

SEQ ID NO: 445 - protein, 35 aa, Artificial Sequence
  Antimicrobial peptide sequence
GLARILLRWLFFRGDNGNGNGGLVRILLRWLFRFG

SEQ ID NO: 446 - protein, 35 aa, Artificial Sequence
  Antimicrobial peptide sequence
GLARILLRWLFFRGDNGNGNGGLARILLRLLFFRG

SEQ ID NO: 447 - protein, 35 aa, Artificial Sequence
  Antimicrobial peptide sequence
GLARILLRWLFFRGDNGNGNGGLARILLRLLFRFG

SEQ ID NO: 448 - protein, 35 aa, Artificial Sequence
  Antimicrobial peptide sequence
GLARILLRWLFFRGDNGNGNGGLVRILLRLLFRFG

SEQ ID NO: 449 - protein, 35 aa, Artificial Sequence
  Antimicrobial peptide sequence
GLARILLRWLFFRGDNGNGNGSLVRILLRLLLRFG

SEQ ID NO: 450 - protein, 35 aa, Artificial Sequence
  Antimicrobial peptide sequence
GLARILLRWLFFRGDNGNGNGGLVRILLRLLLRYG

SEQ ID NO: 451 - protein, 35 aa, Artificial Sequence
  Antimicrobial peptide sequence
GLARILLRWLFFRGDNGNGNGGLAWILLRWLFFRG

SEQ ID NO: 452 - protein, 35 aa, Artificial Sequence
  Antimicrobial peptide sequence
GLARILLRWLFFRGDNGNGNGGLVRILLRWLFFRG

SEQ ID NO: 453 - protein, 35 aa, Artificial Sequence
  Antimicrobial peptide sequence
GLARILLRWLFFRGDNGNGNGGLLRILLRWLFFRG

SEQ ID NO: 454 - protein, 35 aa, Artificial Sequence
  Antimicrobial peptide sequence
GLARILLRWLFFRGDNGNGNGGLPWILLRWLFRFG

SEQ ID NO: 455 - protein, 35 aa, Artificial Sequence
  Antimicrobial peptide sequence
GLARILLRWLFFRGDNGNGNGGLLRILLRWLFRFG

SEQ ID NO: 456 - protein, 35 aa, Artificial Sequence
  Antimicrobial peptide sequence
GLARILLRWLFFRGDNGNGNGGLPWILLRWLFRRG

SEQ ID NO: 457 - protein, 35 aa, Artificial Sequence
  Antimicrobial peptide sequence
GLARILLRWLFFRGDGNGNGNGLPWILLRWLFFRG

SEQ ID NO: 458 - protein, 35 aa, Artificial Sequence
  Antimicrobial peptide sequence
GLARILLRWLFFRGDGNGNGNGLARILLRWLFFRG

SEQ ID NO: 459 - protein, 35 aa, Artificial Sequence
  Antimicrobial peptide sequence
GLARILLRWLFFRGDGNGNGNGLARILLRWLFRFG

SEQ ID NO: 460 - protein, 35 aa, Artificial Sequence
  Antimicrobial peptide sequence
GLARILLRWLFFRGDGNGNGNGLVRILLRWLFRFG

SEQ ID NO: 461 - protein, 35 aa, Artificial Sequence
  Antimicrobial peptide sequence
GLARILLRWLFFRGDGNGNGNGLARILLRLLFFRG

SEQ ID NO: 462 - protein, 35 aa, Artificial Sequence
  Antimicrobial peptide sequence
GLARILLRWLFFRGDGNGNGNGLARILLRLLFRFG

SEQ ID NO: 463 - protein, 35 aa, Artificial Sequence
  Antimicrobial peptide sequence
GLARILLRWLFFRGDGNGNGNGLVRILLRLLFRFG

SEQ ID NO: 464 - protein, 35 aa, Artificial Sequence
  Antimicrobial peptide sequence
GLARILLRWLFFRGDGNGNGNSLVRILLRLLLRFG

SEQ ID NO: 465 - protein, 35 aa, Artificial Sequence
  Antimicrobial peptide sequence
GLARILLRWLFFRGDGNGNGNGLVRILLRLLLRYG

SEQ ID NO: 466 - protein, 35 aa, Artificial Sequence
  Antimicrobial peptide sequence
GLARILLRWLFFRGDGNGNGNGLAWILLRWLFFRG

SEQ ID NO: 467 - protein, 35 aa, Artificial Sequence
  Antimicrobial peptide sequence
GLARILLRWLFFRGDGNGNGNGLVRILLRWLFFRG

SEQ ID NO: 468 - protein, 35 aa, Artificial Sequence
  Antimicrobial peptide sequence
GLARILLRWLFFRGDGNGNGNGLLRILLRWLFFRG

SEQ ID NO: 469 - protein, 35 aa, Artificial Sequence
  Antimicrobial peptide sequence
GLARILLRWLFFRGDGNGNGNGLPWILLRWLFRFG

SEQ ID NO: 470 - protein, 35 aa, Artificial Sequence
  Antimicrobial peptide sequence
GLARILLRWLFFRGDGNGNGNGLLRILLRWLFRFG

SEQ ID NO: 471 - protein, 35 aa, Artificial Sequence
  Antimicrobial peptide sequence
GLARILLRWLFFRGDGNGNGNGLPWILLRWLFRRG

SEQ ID NO: 472 - protein, 35 aa, Artificial Sequence
  Antimicrobial peptide sequence
GLARILLRWLFFRGDSGSGSGGLPWILLRWLFFRG

SEQ ID NO: 473 - protein, 35 aa, Artificial Sequence
  Antimicrobial peptide sequence
GLARILLRWLFFRGDSGSGSGGLARILLRWLFFRG

SEQ ID NO: 474 - protein, 35 aa, Artificial Sequence
  Antimicrobial peptide sequence
GLARILLRWLFFRGDSGSGSGGLARILLRWLFRFG

SEQ ID NO: 475 - protein, 35 aa, Artificial Sequence
  Antimicrobial peptide sequence
GLARILLRWLFFRGDSGSGSGGLVRILLRWLFRFG

SEQ ID NO: 476 - protein, 35 aa, Artificial Sequence
  Antimicrobial peptide sequence
GLARILLRWLFFRGDSGSGSGGLARILLRLLFFRG

SEQ ID NO: 477 - protein, 35 aa, Artificial Sequence
  Antimicrobial peptide sequence
GLARILLRWLFFRGDSGSGSGGLARILLRLLFRFG

SEQ ID NO: 478 - protein, 35 aa, Artificial Sequence
  Antimicrobial peptide sequence
GLARILLRWLFFRGDSGSGSGGLVRILLRLLFRFG

SEQ ID NO: 479 - protein, 35 aa, Artificial Sequence
  Antimicrobial peptide sequence
GLARILLRWLFFRGDSGSGSGSLVRILLRLLLRFG

SEQ ID NO: 480 - protein, 35 aa, Artificial Sequence
  Antimicrobial peptide sequence
GLARILLRWLFFRGDSGSGSGGLVRILLRLLLRYG

SEQ ID NO: 481 - protein, 35 aa, Artificial Sequence
  Antimicrobial peptide sequence
GLARILLRWLFFRGDSGSGSGGLAWILLRWLFFRG

SEQ ID NO: 482 - protein, 35 aa, Artificial Sequence
  Antimicrobial peptide sequence
GLARILLRWLFFRGDSGSGSGGLVRILLRWLFFRG

SEQ ID NO: 483 - protein, 35 aa, Artificial Sequence
  Antimicrobial peptide sequence
GLARILLRWLFFRGDSGSGSGGLLRILLRWLFFRG

SEQ ID NO: 484 - protein, 35 aa, Artificial Sequence
  Antimicrobial peptide sequence
GLARILLRWLFFRGDSGSGSGGLPWILLRWLFRFG

SEQ ID NO: 485 - protein, 35 aa, Artificial Sequence
  Antimicrobial peptide sequence
GLARILLRWLFFRGDSGSGSGGLLRILLRWLFRFG

SEQ ID NO: 486 - protein, 35 aa, Artificial Sequence
  Antimicrobial peptide sequence
GLARILLRWLFFRGDSGSGSGGLPWILLRWLFRRG

SEQ ID NO: 487 - protein, 35 aa, Artificial Sequence
  Antimicrobial peptide sequence
GLARILLRWLFFRGDGSGSGSGLPWILLRWLFFRG

SEQ ID NO: 488 - protein, 35 aa, Artificial Sequence
  Antimicrobial peptide sequence
GLARILLRWLFFRGDGSGSGSGLARILLRWLFFRG

SEQ ID NO: 489 - protein, 35 aa, Artificial Sequence
  Antimicrobial peptide sequence
GLARILLRWLFFRGDGSGSGSGLARILLRWLFRFG

SEQ ID NO: 490 - protein, 35 aa, Artificial Sequence
  Antimicrobial peptide sequence
GLARILLRWLFFRGDGSGSGSGLVRILLRWLFRFG

SEQ ID NO: 491 - protein, 35 aa, Artificial Sequence
  Antimicrobial peptide sequence
GLARILLRWLFFRGDGSGSGSGLARILLRLLFFRG

SEQ ID NO: 492 - protein, 35 aa, Artificial Sequence
  Antimicrobial peptide sequence
GLARILLRWLFFRGDGSGSGSGLARILLRLLFRFG

SEQ ID NO: 493 - protein, 35 aa, Artificial Sequence
  Antimicrobial peptide sequence
GLARILLRWLFFRGDGSGSGSGLVRILLRLLFRFG

SEQ ID NO: 494 - protein, 35 aa, Artificial Sequence
  Antimicrobial peptide sequence
GLARILLRWLFFRGDGSGSGSSLVRILLRLLLRFG

SEQ ID NO: 495 - protein, 35 aa, Artificial Sequence
  Antimicrobial peptide sequence
GLARILLRWLFFRGDGSGSGSGLVRILLRLLLRYG

SEQ ID NO: 496 - protein, 35 aa, Artificial Sequence
  Antimicrobial peptide sequence
GLARILLRWLFFRGDGSGSGSGLAWILLRWLFFRG

SEQ ID NO: 497 - protein, 35 aa, Artificial Sequence
  Antimicrobial peptide sequence
GLARILLRWLFFRGDGSGSGSGLVRILLRWLFFRG

SEQ ID NO: 498 - protein, 35 aa, Artificial Sequence
  Antimicrobial peptide sequence
GLARILLRWLFFRGDGSGSGSGLLRILLRWLFFRG

SEQ ID NO: 499 - protein, 35 aa, Artificial Sequence
  Antimicrobial peptide sequence
GLARILLRWLFFRGDGSGSGSGLPWILLRWLFRFG

SEQ ID NO: 500 - protein, 35 aa, Artificial Sequence
  Antimicrobial peptide sequence
GLARILLRWLFFRGDGSGSGSGLLRILLRWLFRFG

SEQ ID NO: 501 - protein, 35 aa, Artificial Sequence
  Antimicrobial peptide sequence
GLARILLRWLFFRGDGSGSGSGLPWILLRWLFRRG

SEQ ID NO: 502 - protein, 35 aa, Artificial Sequence
  Antimicrobial peptide sequence
GLARILLRWLFFRGDSNSNSNGLPWILLRWLFFRG

SEQ ID NO: 503 - protein, 35 aa, Artificial Sequence
  Antimicrobial peptide sequence
GLARILLRWLFFRGDSNSNSNGLARILLRWLFFRG

SEQ ID NO: 504 - protein, 35 aa, Artificial Sequence
  Antimicrobial peptide sequence
GLARILLRWLFFRGDSNSNSNGLARILLRWLFRFG

SEQ ID NO: 505 - protein, 35 aa, Artificial Sequence
  Antimicrobial peptide sequence
GLARILLRWLFFRGDSNSNSNGLVRILLRWLFRFG

SEQ ID NO: 506 - protein, 35 aa, Artificial Sequence
  Antimicrobial peptide sequence
GLARILLRWLFFRGDSNSNSNGLARILLRLLFFRG

SEQ ID NO: 507 - protein, 35 aa, Artificial Sequence
  Antimicrobial peptide sequence
GLARILLRWLFFRGDSNSNSNGLARILLRLLFRFG

SEQ ID NO: 508 - protein, 35 aa, Artificial Sequence
  Antimicrobial peptide sequence
GLARILLRWLFFRGDSNSNSNGLVRILLRLLFRFG

SEQ ID NO: 509 - protein, 35 aa, Artificial Sequence
  Antimicrobial peptide sequence
GLARILLRWLFFRGDSNSNSNSLVRILLRLLLRFG

SEQ ID NO: 510 - protein, 35 aa, Artificial Sequence
  Antimicrobial peptide sequence
GLARILLRWLFFRGDSNSNSNGLVRILLRLLLRYG

SEQ ID NO: 511 - protein, 35 aa, Artificial Sequence
  Antimicrobial peptide sequence
GLARILLRWLFFRGDSNSNSNGLAWILLRWLFFRG

SEQ ID NO: 512 - protein, 35 aa, Artificial Sequence
  Antimicrobial peptide sequence
GLARILLRWLFFRGDSNSNSNGLVRILLRWLFFRG

SEQ ID NO: 513 - protein, 35 aa, Artificial Sequence
  Antimicrobial peptide sequence
GLARILLRWLFFRGDSNSNSNGLLRILLRWLFFRG

SEQ ID NO: 514 - protein, 35 aa, Artificial Sequence
  Antimicrobial peptide sequence
GLARILLRWLFFRGDSNSNSNGLPWILLRWLFRFG

SEQ ID NO: 515 - protein, 35 aa, Artificial Sequence
  Antimicrobial peptide sequence
GLARILLRWLFFRGDSNSNSNGLLRILLRWLFRFG

SEQ ID NO: 516 - protein, 35 aa, Artificial Sequence
  Antimicrobial peptide sequence
GLARILLRWLFFRGDSNSNSNGLPWILLRWLFRRG

SEQ ID NO: 517 - protein, 35 aa, Artificial Sequence
  Antimicrobial peptide sequence
GLARILLRWLFFRGDNSNSNSGLPWILLRWLFFRG

SEQ ID NO: 518 - protein, 35 aa, Artificial Sequence
  Antimicrobial peptide sequence
GLARILLRWLFFRGDNSNSNSGLARILLRWLFFRG

SEQ ID NO: 519 - protein, 35 aa, Artificial Sequence
  Antimicrobial peptide sequence
GLARILLRWLFFRGDNSNSNSGLARILLRWLFRFG

SEQ ID NO: 520 - protein, 35 aa, Artificial Sequence
  Antimicrobial peptide sequence
GLARILLRWLFFRGDNSNSNSGLVRILLRWLFRFG

SEQ ID NO: 521 - protein, 35 aa, Artificial Sequence
  Antimicrobial peptide sequence
GLARILLRWLFFRGDNSNSNSGLARILLRLLFFRG

SEQ ID NO: 522 - protein, 35 aa, Artificial Sequence
  Antimicrobial peptide sequence
GLARILLRWLFFRGDNSNSNSGLARILLRLLFRFG

SEQ ID NO: 523 - protein, 35 aa, Artificial Sequence
  Antimicrobial peptide sequence
GLARILLRWLFFRGDNSNSNSGLVRILLRLLFRFG

SEQ ID NO: 524 - protein, 35 aa, Artificial Sequence
  Antimicrobial peptide sequence
GLARILLRWLFFRGDNSNSNSSLVRILLRLLLRFG

SEQ ID NO: 525 - protein, 35 aa, Artificial Sequence
  Antimicrobial peptide sequence
GLARILLRWLFFRGDNSNSNSGLVRILLRLLLRYG

SEQ ID NO: 526 - protein, 35 aa, Artificial Sequence
  Antimicrobial peptide sequence
GLARILLRWLFFRGDNSNSNSGLAWILLRWLFFRG

SEQ ID NO: 527 - protein, 35 aa, Artificial Sequence
  Antimicrobial peptide sequence
GLARILLRWLFFRGDNSNSNSGLVRILLRWLFFRG

SEQ ID NO: 528 - protein, 35 aa, Artificial Sequence
  Antimicrobial peptide sequence
GLARILLRWLFFRGDNSNSNSGLLRILLRWLFFRG

SEQ ID NO: 529 - protein, 35 aa, Artificial Sequence
  Antimicrobial peptide sequence
GLARILLRWLFFRGDNSNSNSGLPWILLRWLFRFG

SEQ ID NO: 530 - protein, 35 aa, Artificial Sequence
  Antimicrobial peptide sequence
GLARILLRWLFFRGDNSNSNSGLLRILLRWLFRFG

SEQ ID NO: 531 - protein, 35 aa, Artificial Sequence
  Antimicrobial peptide sequence
GLARILLRWLFFRGDNSNSNSGLPWILLRWLFRRG

SEQ ID NO: 532 - protein, 35 aa, Artificial Sequence
  Antimicrobial peptide sequence
GLARILLRWLFFRGDHGHGHGGLPWILLRWLFFRG

SEQ ID NO: 533 - protein, 35 aa, Artificial Sequence
  Antimicrobial peptide sequence
GLARILLRWLFFRGDHGHGHGGLARILLRWLFFRG

SEQ ID NO: 534 - protein, 35 aa, Artificial Sequence
  Antimicrobial peptide sequence
GLARILLRWLFFRGDHGHGHGGLARILLRWLFRFG

SEQ ID NO: 535 - protein, 35 aa, Artificial Sequence
  Antimicrobial peptide sequence
GLARILLRWLFFRGDHGHGHGGLVRILLRWLFRFG

SEQ ID NO: 536 - protein, 35 aa, Artificial Sequence
  Antimicrobial peptide sequence
GLARILLRWLFFRGDHGHGHGGLARILLRLLFFRG

SEQ ID NO: 537 - protein, 35 aa, Artificial Sequence
  Antimicrobial peptide sequence
GLARILLRWLFFRGDHGHGHGGLARILLRLLFRFG

SEQ ID NO: 538 - protein, 35 aa, Artificial Sequence
  Antimicrobial peptide sequence
GLARILLRWLFFRGDHGHGHGGLVRILLRLLFRFG

SEQ ID NO: 539 - protein, 35 aa, Artificial Sequence
  Antimicrobial peptide sequence
GLARILLRWLFFRGDHGHGHGSLVRILLRLLLRFG

SEQ ID NO: 540 - protein, 35 aa, Artificial Sequence
  Antimicrobial peptide sequence
GLARILLRWLFFRGDHGHGHGGLVRILLRLLLRYG

SEQ ID NO: 541 - protein, 35 aa, Artificial Sequence
  Antimicrobial peptide sequence
GLARILLRWLFFRGDHGHGHGGLAWILLRWLFFRG

SEQ ID NO: 542 - protein, 35 aa, Artificial Sequence
  Antimicrobial peptide sequence
GLARILLRWLFFRGDHGHGHGGLVRILLRWLFFRG

SEQ ID NO: 543 - protein, 35 aa, Artificial Sequence
  Antimicrobial peptide sequence
GLARILLRWLFFRGDHGHGHGGLLRILLRWLFFRG

SEQ ID NO: 544 - protein, 35 aa, Artificial Sequence
  Antimicrobial peptide sequence
GLARILLRWLFFRGDHGHGHGGLPWILLRWLFRFG

SEQ ID NO: 545 - protein, 35 aa, Artificial Sequence
  Antimicrobial peptide sequence
GLARILLRWLFFRGDHGHGHGGLLRILLRWLFRFG

SEQ ID NO: 546 - protein, 35 aa, Artificial Sequence
  Antimicrobial peptide sequence
GLARILLRWLFFRGDHGHGHGGLPWILLRWLFRRG

SEQ ID NO: 547 - protein, 35 aa, Artificial Sequence
  Antimicrobial peptide sequence
GLARILLRWLFFRGDGHGHGHGLPWILLRWLFFRG

SEQ ID NO: 548 - protein, 35 aa, Artificial Sequence
  Antimicrobial peptide sequence
GLARILLRWLFFRGDGHGHGHGLARILLRWLFFRG

SEQ ID NO: 549 - protein, 35 aa, Artificial Sequence
  Antimicrobial peptide sequence
GLARILLRWLFFRGDGHGHGHGLARILLRWLFRFG

SEQ ID NO: 550 - protein, 35 aa, Artificial Sequence
  Antimicrobial peptide sequence
GLARILLRWLFFRGDGHGHGHGLVRILLRWLFRFG

SEQ ID NO: 551 - protein, 35 aa, Artificial Sequence
  Antimicrobial peptide sequence
GLARILLRWLFFRGDGHGHGHGLARILLRLLFFRG

SEQ ID NO: 552 - protein, 35 aa, Artificial Sequence
  Antimicrobial peptide sequence
GLARILLRWLFFRGDGHGHGHGLARILLRLLFRFG

SEQ ID NO: 553 - protein, 35 aa, Artificial Sequence
  Antimicrobial peptide sequence
GLARILLRWLFFRGDGHGHGHGLVRILLRLLFRFG

SEQ ID NO: 554 - protein, 35 aa, Artificial Sequence
  Antimicrobial peptide sequence
GLARILLRWLFFRGDGHGHGHSLVRILLRLLLRFG

SEQ ID NO: 555 - protein, 35 aa, Artificial Sequence
  Antimicrobial peptide sequence
GLARILLRWLFFRGDGHGHGHGLVRILLRLLLRYG

SEQ ID NO: 556 - protein, 35 aa, Artificial Sequence
  Antimicrobial peptide sequence
GLARILLRWLFFRGDGHGHGHGLAWILLRWLFFRG

SEQ ID NO: 557 - protein, 35 aa, Artificial Sequence
  Antimicrobial peptide sequence
GLARILLRWLFFRGDGHGHGHGLVRILLRWLFFRG

SEQ ID NO: 558 - protein, 35 aa, Artificial Sequence
  Antimicrobial peptide sequence
GLARILLRWLFFRGDGHGHGHGLLRILLRWLFFRG

SEQ ID NO: 559 - protein, 35 aa, Artificial Sequence
  Antimicrobial peptide sequence
GLARILLRWLFFRGDGHGHGHGLPWILLRWLFRFG

SEQ ID NO: 560 - protein, 35 aa, Artificial Sequence
  Antimicrobial peptide sequence
GLARILLRWLFFRGDGHGHGHGLLRILLRWLFRFG

SEQ ID NO: 561 - protein, 35 aa, Artificial Sequence
  Antimicrobial peptide sequence
GLARILLRWLFFRGDGHGHGHGLPWILLRWLFRRG

SEQ ID NO: 562 - protein, 35 aa, Artificial Sequence
  Antimicrobial peptide sequence
GLARILLRWLFFRGDHNHNHNGLPWILLRWLFFRG

SEQ ID NO: 563 - protein, 35 aa, Artificial Sequence
  Antimicrobial peptide sequence
GLARILLRWLFFRGDHNHNHNGLARILLRWLFFRG

SEQ ID NO: 564 - protein, 35 aa, Artificial Sequence
  Antimicrobial peptide sequence
GLARILLRWLFFRGDHNHNHNGLARILLRWLFRFG

SEQ ID NO: 565 - protein, 35 aa, Artificial Sequence
  Antimicrobial peptide sequence
GLARILLRWLFFRGDHNHNHNGLVRILLRWLFRFG

SEQ ID NO: 566 - protein, 35 aa, Artificial Sequence
  Antimicrobial peptide sequence
GLARILLRWLFFRGDHNHNHNGLARILLRLLFFRG

SEQ ID NO: 567 - protein, 35 aa, Artificial Sequence
  Antimicrobial peptide sequence
GLARILLRWLFFRGDHNHNHNGLARILLRLLFRFG

SEQ ID NO: 568 - protein, 35 aa, Artificial Sequence
  Antimicrobial peptide sequence
GLARILLRWLFFRGDHNHNHNGLVRILLRLLFRFG

SEQ ID NO: 569 - protein, 35 aa, Artificial Sequence
  Antimicrobial peptide sequence
GLARILLRWLFFRGDHNHNHNSLVRILLRLLLRFG

SEQ ID NO: 570 - protein, 35 aa, Artificial Sequence
  Antimicrobial peptide sequence
GLARILLRWLFFRGDHNHNHNGLVRILLRLLLRYG

SEQ ID NO: 571 - protein, 35 aa, Artificial Sequence
  Antimicrobial peptide sequence
GLARILLRWLFFRGDHNHNHNGLAWILLRWLFFRG

SEQ ID NO: 572 - protein, 35 aa, Artificial Sequence
  Antimicrobial peptide sequence
GLARILLRWLFFRGDHNHNHNGLVRILLRWLFFRG

SEQ ID NO: 573 - protein, 35 aa, Artificial Sequence
  Antimicrobial peptide sequence
GLARILLRWLFFRGDHNHNHNGLLRILLRWLFFRG

SEQ ID NO: 574 - protein, 35 aa, Artificial Sequence
  Antimicrobial peptide sequence
GLARILLRWLFFRGDHNHNHNGLPWILLRWLFRFG

SEQ ID NO: 575 - protein, 35 aa, Artificial Sequence
  Antimicrobial peptide sequence
GLARILLRWLFFRGDHNHNHNGLLRILLRWLFRFG

SEQ ID NO: 576 - protein, 35 aa, Artificial Sequence
  Antimicrobial peptide sequence
GLARILLRWLFFRGDHNHNHNGLPWILLRWLFRRG

SEQ ID NO: 577 - protein, 35 aa, Artificial Sequence
  Antimicrobial peptide sequence
GLARILLRWLFFRGDNHNHNHGLPWILLRWLFFRG

SEQ ID NO: 578 - protein, 35 aa, Artificial Sequence
  Antimicrobial peptide sequence
GLARILLRWLFFRGDNHNHNHGLARILLRWLFFRG

SEQ ID NO: 579 - protein, 35 aa, Artificial Sequence
  Antimicrobial peptide sequence
GLARILLRWLFFRGDNHNHNHGLARILLRWLFRFG

SEQ ID NO: 580 - protein, 35 aa, Artificial Sequence
  Antimicrobial peptide sequence
GLARILLRWLFFRGDNHNHNHGLVRILLRWLFRFG

SEQ ID NO: 581 - protein, 35 aa, Artificial Sequence
  Antimicrobial peptide sequence
GLARILLRWLFFRGDNHNHNHGLARILLRLLFFRG

SEQ ID NO: 582 - protein, 35 aa, Artificial Sequence
  Antimicrobial peptide sequence
GLARILLRWLFFRGDNHNHNHGLARILLRLLFRFG

SEQ ID NO: 583 - protein, 35 aa, Artificial Sequence
  Antimicrobial peptide sequence
GLARILLRWLFFRGDNHNHNHGLVRILLRLLFRFG

SEQ ID NO: 584 - protein, 35 aa, Artificial Sequence
  Antimicrobial peptide sequence
GLARILLRWLFFRGDNHNHNHSLVRILLRLLLRFG

SEQ ID NO: 585 - protein, 35 aa, Artificial Sequence
  Antimicrobial peptide sequence
GLARILLRWLFFRGDNHNHNHGLVRILLRLLLRYG

SEQ ID NO: 586 - protein, 35 aa, Artificial Sequence
  Antimicrobial peptide sequence
GLARILLRWLFFRGDNHNHNHGLAWILLRWLFFRG

SEQ ID NO: 587 - protein, 35 aa, Artificial Sequence
  Antimicrobial peptide sequence
GLARILLRWLFFRGDNHNHNHGLVRILLRWLFFRG

SEQ ID NO: 588 - protein, 35 aa, Artificial Sequence
  Antimicrobial peptide sequence
GLARILLRWLFFRGDNHNHNHGLLRILLRWLFFRG

SEQ ID NO: 589 - protein, 35 aa, Artificial Sequence
  Antimicrobial peptide sequence
GLARILLRWLFFRGDNHNHNHGLPWILLRWLFRFG

SEQ ID NO: 590 - protein, 35 aa, Artificial Sequence
  Antimicrobial peptide sequence
GLARILLRWLFFRGDNHNHNHGLLRILLRWLFRFG

SEQ ID NO: 591 - protein, 35 aa, Artificial Sequence
  Antimicrobial peptide sequence
GLARILLRWLFFRGDNHNHNHGLPWILLRWLFRRG

SEQ ID NO: 592 - protein, 33 aa, Artificial Sequence
  Antimicrobial peptide sequence
GLARILLRWLFRFGDGGGGGLPWILLRWLFFRG

SEQ ID NO: 593 - protein, 33 aa, Artificial Sequence
  Antimicrobial peptide sequence
GLARILLRWLFRFGDGGGGGLARILLRWLFFRG

SEQ ID NO: 594 - protein, 33 aa, Artificial Sequence
  Antimicrobial peptide sequence
GLARILLRWLFRFGDGGGGGLARILLRWLFRFG

SEQ ID NO: 595 - protein, 33 aa, Artificial Sequence
  Antimicrobial peptide sequence
GLARILLRWLFRFGDGGGGGLVRILLRWLFRFG

SEQ ID NO: 596 - protein, 33 aa, Artificial Sequence
  Antimicrobial peptide sequence
GLARILLRWLFRFGDGGGGGLARILLRLLFFRG

SEQ ID NO: 597 - protein, 33 aa, Artificial Sequence
  Antimicrobial peptide sequence
GLARILLRWLFRFGDGGGGGLARILLRLLFRFG

SEQ ID NO: 598 - protein, 33 aa, Artificial Sequence
  Antimicrobial peptide sequence
GLARILLRWLFRFGDGGGGGLVRILLRLLFRFG

SEQ ID NO: 599 - protein, 33 aa, Artificial Sequence
  Antimicrobial peptide sequence
GLARILLRWLFRFGDGGGGSLVRILLRLLLRFG

SEQ ID NO: 600 - protein, 33 aa, Artificial Sequence
  Antimicrobial peptide sequence
GLARILLRWLFRFGDGGGGGLVRILLRLLLRYG

SEQ ID NO: 601 - protein, 33 aa, Artificial Sequence
  Antimicrobial peptide sequence
GLARILLRWLFRFGDGGGGGLAWILLRWLFFRG

SEQ ID NO: 602 - protein, 33 aa, Artificial Sequence
  Antimicrobial peptide sequence
GLARILLRWLFRFGDGGGGGLVRILLRWLFFRG

SEQ ID NO: 603 - protein, 33 aa, Artificial Sequence
  Antimicrobial peptide sequence
GLARILLRWLFRFGDGGGGGLLRILLRWLFFRG

SEQ ID NO: 604 - protein, 33 aa, Artificial Sequence
  Antimicrobial peptide sequence
GLARILLRWLFRFGDGGGGGLPWILLRWLFRFG

SEQ ID NO: 605 - protein, 33 aa, Artificial Sequence
  Antimicrobial peptide sequence
GLARILLRWLFRFGDGGGGGLLRILLRWLFRFG

SEQ ID NO: 606 - protein, 33 aa, Artificial Sequence
  Antimicrobial peptide sequence
GLARILLRWLFRFGDGGGGGLPWILLRWLFRRG

SEQ ID NO: 607 - protein, 34 aa, Artificial Sequence
  Antimicrobial peptide sequence
GLARILLRWLFRFGDGGGGGGLPWILLRWLFFRG

SEQ ID NO: 608 - protein, 34 aa, Artificial Sequence
  Antimicrobial peptide sequence
GLARILLRWLFRFGDGGGGGGLARILLRWLFFRG

SEQ ID NO: 609 - protein, 34 aa, Artificial Sequence; identical to SEQ ID NO: 48
  Antimicrobial peptide sequence

SEQ ID NO: 610 - protein, 34 aa, Artificial Sequence
  Antimicrobial peptide sequence
GLARILLRWLFRFGDGGGGGGLVRILLRWLFRFG

SEQ ID NO: 611 - protein, 34 aa, Artificial Sequence
  Antimicrobial peptide sequence
GLARILLRWLFRFGDGGGGGGLARILLRLLFFRG

SEQ ID NO: 612 - protein, 34 aa, Artificial Sequence
  Antimicrobial peptide sequence
GLARILLRWLFRFGDGGGGGGLARILLRLLFRFG

SEQ ID NO: 613 - protein, 34 aa, Artificial Sequence
  Antimicrobial peptide sequence
GLARILLRWLFRFGDGGGGGGLVRILLRLLFRFG

SEQ ID NO: 614 - protein, 34 aa, Artificial Sequence
  Antimicrobial peptide sequence
GLARILLRWLFRFGDGGGGGSLVRILLRLLLRFG

SEQ ID NO: 615 - protein, 34 aa, Artificial Sequence
  Antimicrobial peptide sequence
GLARILLRWLFRFGDGGGGGGLVRILLRLLLRYG

SEQ ID NO: 616 - protein, 34 aa, Artificial Sequence
  Antimicrobial peptide sequence
GLARILLRWLFRFGDGGGGGGLAWILLRWLFFRG

SEQ ID NO: 617 - protein, 34 aa, Artificial Sequence
  Antimicrobial peptide sequence
GLARILLRWLFRFGDGGGGGGLVRILLRWLFFRG

SEQ ID NO: 618 - protein, 34 aa, Artificial Sequence
  Antimicrobial peptide sequence
GLARILLRWLFRFGDGGGGGGLLRILLRWLFFRG

SEQ ID NO: 619 - protein, 34 aa, Artificial Sequence
  Antimicrobial peptide sequence
GLARILLRWLFRFGDGGGGGGLPWILLRWLFRFG

SEQ ID NO: 620 - protein, 34 aa, Artificial Sequence
  Antimicrobial peptide sequence
GLARILLRWLFRFGDGGGGGGLLRILLRWLFRFG

SEQ ID NO: 621 - protein, 34 aa, Artificial Sequence
  Antimicrobial peptide sequence
GLARILLRWLFRFGDGGGGGGLPWILLRWLFRRG

SEQ ID NO: 622 - protein, 35 aa, Artificial Sequence
  Antimicrobial peptide sequence
GLARILLRWLFRFGDGGGGGGGLPWILLRWLFFRG

SEQ ID NO: 623 - protein, 35 aa, Artificial Sequence
  Antimicrobial peptide sequence
GLARILLRWLFRFGDGGGGGGGLARILLRWLFFRG

SEQ ID NO: 624 - protein, 35 aa, Artificial Sequence; identical to SEQ ID NO: 42
  Antimicrobial peptide sequence

SEQ ID NO: 625 - protein, 35 aa, Artificial Sequence
  Antimicrobial peptide sequence
GLARILLRWLFRFGDGGGGGGGLVRILLRWLFRFG

SEQ ID NO: 626 - protein, 35 aa, Artificial Sequence
  Antimicrobial peptide sequence
GLARILLRWLFRFGDGGGGGGGLARILLRLLFFRG

SEQ ID NO: 627 - protein, 35 aa, Artificial Sequence
  Antimicrobial peptide sequence
GLARILLRWLFRFGDGGGGGGGLARILLRLLFRFG

SEQ ID NO: 628 - protein, 35 aa, Artificial Sequence
  Antimicrobial peptide sequence
GLARILLRWLFRFGDGGGGGGGLVRILLRLLFRFG

SEQ ID NO: 629 - protein, 35 aa, Artificial Sequence
  Antimicrobial peptide sequence
GLARILLRWLFRFGDGGGGGGSLVRILLRLLLRFG

SEQ ID NO: 630 - protein, 35 aa, Artificial Sequence
  Antimicrobial peptide sequence
GLARILLRWLFRFGDGGGGGGGLVRILLRLLLRYG

SEQ ID NO: 631 - protein, 35 aa, Artificial Sequence
  Antimicrobial peptide sequence
GLARILLRWLFRFGDGGGGGGGLAWILLRWLFFRG

SEQ ID NO: 632 - protein, 35 aa, Artificial Sequence
  Antimicrobial peptide sequence
GLARILLRWLFRFGDGGGGGGGLVRILLRWLFFRG

SEQ ID NO: 633 - protein, 35 aa, Artificial Sequence
  Antimicrobial peptide sequence
GLARILLRWLFRFGDGGGGGGGLLRILLRWLFFRG

SEQ ID NO: 634 - protein, 35 aa, Artificial Sequence
  Antimicrobial peptide sequence
GLARILLRWLFRFGDGGGGGGGLPWILLRWLFRFG

SEQ ID NO: 635 - protein, 35 aa, Artificial Sequence
  Antimicrobial peptide sequence
GLARILLRWLFRFGDGGGGGGGLLRILLRWLFRFG

SEQ ID NO: 636 - protein, 35 aa, Artificial Sequence
  Antimicrobial peptide sequence
GLARILLRWLFRFGDGGGGGGGLPWILLRWLFRRG

SEQ ID NO: 637 - protein, 36 aa, Artificial Sequence
  Antimicrobial peptide sequence
GLARILLRWLFRFGDGGGGGGGGLPWILLRWLFFRG

SEQ ID NO: 638 - protein, 36 aa, Artificial Sequence
  Antimicrobial peptide sequence
GLARILLRWLFRFGDGGGGGGGGLARILLRWLFFRG

SEQ ID NO: 639 - protein, 36 aa, Artificial Sequence
  Antimicrobial peptide sequence
GLARILLRWLFRFGDGGGGGGGGLARILLRWLFRFG

SEQ ID NO: 640 - protein, 36 aa, Artificial Sequence
  Antimicrobial peptide sequence
GLARILLRWLFRFGDGGGGGGGGLVRILLRWLFRFG

SEQ ID NO: 641 - protein, 36 aa, Artificial Sequence
  Antimicrobial peptide sequence
GLARILLRWLFRFGDGGGGGGGGLARILLRLLFFRG

SEQ ID NO: 642 - protein, 36 aa, Artificial Sequence
  Antimicrobial peptide sequence
GLARILLRWLFRFGDGGGGGGGGLARILLRLLFRFG

SEQ ID NO: 643 - protein, 36 aa, Artificial Sequence
  Antimicrobial peptide sequence
GLARILLRWLFRFGDGGGGGGGGLVRILLRLLFRFG

SEQ ID NO: 644 - protein, 36 aa, Artificial Sequence
  Antimicrobial peptide sequence
GLARILLRWLFRFGDGGGGGGGSLVRILLRLLLRFG

SEQ ID NO: 645 - protein, 36 aa, Artificial Sequence
  Antimicrobial peptide sequence
GLARILLRWLFRFGDGGGGGGGGLVRILLRLLLRYG

SEQ ID NO: 646 - protein, 36 aa, Artificial Sequence
  Antimicrobial peptide sequence
GLARILLRWLFRFGDGGGGGGGGLAWILLRWLFFRG

SEQ ID NO: 647 - protein, 36 aa, Artificial Sequence
  Antimicrobial peptide sequence
GLARILLRWLFRFGDGGGGGGGGLVRILLRWLFFRG

SEQ ID NO: 648 - protein, 36 aa, Artificial Sequence
  Antimicrobial peptide sequence
GLARILLRWLFRFGDGGGGGGGGLLRILLRWLFFRG

SEQ ID NO: 649 - protein, 36 aa, Artificial Sequence
  Antimicrobial peptide sequence
GLARILLRWLFRFGDGGGGGGGGLPWILLRWLFRFG

SEQ ID NO: 650 - protein, 36 aa, Artificial Sequence
  Antimicrobial peptide sequence
GLARILLRWLFRFGDGGGGGGGGLLRILLRWLFRFG

SEQ ID NO: 651 - protein, 36 aa, Artificial Sequence
  Antimicrobial peptide sequence
GLARILLRWLFRFGDGGGGGGGGLPWILLRWLFRRG

SEQ ID NO: 652 - protein, 33 aa, Artificial Sequence
  Antimicrobial peptide sequence
GLARILLRWLFRFGDNNNNGLPWILLRWLFFRG

SEQ ID NO: 653 - protein, 33 aa, Artificial Sequence
  Antimicrobial peptide sequence
GLARILLRWLFRFGDNNNNGLARILLRWLFFRG

SEQ ID NO: 654 - protein, 33 aa, Artificial Sequence
  Antimicrobial peptide sequence
GLARILLRWLFRFGDNNNNGLARILLRWLFRFG

SEQ ID NO: 655 - protein, 33 aa, Artificial Sequence
  Antimicrobial peptide sequence
GLARILLRWLFRFGDNNNNGLVRILLRWLFRFG

SEQ ID NO: 656 - protein, 33 aa, Artificial Sequence
  Antimicrobial peptide sequence
GLARILLRWLFRFGDNNNNGLARILLRLLFFRG

SEQ ID NO: 657 - protein, 33 aa, Artificial Sequence
  Antimicrobial peptide sequence
GLARILLRWLFRFGDNNNNGLARILLRLLFRFG

SEQ ID NO: 658 - protein, 33 aa, Artificial Sequence
  Antimicrobial peptide sequence
GLARILLRWLFRFGDNNNNGLVRILLRLLFRFG

SEQ ID NO: 659 - protein, 33 aa, Artificial Sequence
  Antimicrobial peptide sequence
GLARILLRWLFRFGDNNNNSLVRILLRLLLRFG

SEQ ID NO: 660 - protein, 33 aa, Artificial Sequence
  Antimicrobial peptide sequence
GLARILLRWLFRFGDNNNNGLVRILLRLLLRYG

SEQ ID NO: 661 - protein, 33 aa, Artificial Sequence
  Antimicrobial peptide sequence
GLARILLRWLFRFGDNNNNGLAWILLRWLFFRG

SEQ ID NO: 662 - protein, 33 aa, Artificial Sequence
  Antimicrobial peptide sequence
GLARILLRWLFRFGDNNNNGLVRILLRWLFFRG

SEQ ID NO: 663 - protein, 33 aa, Artificial Sequence
  Antimicrobial peptide sequence
GLARILLRWLFRFGDNNNNGLLRILLRWLFFRG

SEQ ID NO: 664 - protein, 33 aa, Artificial Sequence
  Antimicrobial peptide sequence
GLARILLRWLFRFGDNNNNGLPWILLRWLFRFG

SEQ ID NO: 665 - protein, 33 aa, Artificial Sequence
  Antimicrobial peptide sequence
GLARILLRWLFRFGDNNNNGLLRILLRWLFRFG

SEQ ID NO: 666 - protein, 33 aa, Artificial Sequence
  Antimicrobial peptide sequence
GLARILLRWLFRFGDNNNNGLPWILLRWLFRRG

SEQ ID NO: 667 - protein, 34 aa, Artificial Sequence
  Antimicrobial peptide sequence
GLARILLRWLFRFGDNNNNNGLPWILLRWLFFRG

SEQ ID NO: 668 - protein, 34 aa, Artificial Sequence
  Antimicrobial peptide sequence
GLARILLRWLFRFGDNNNNNGLARILLRWLFFRG

SEQ ID NO: 669 - protein, 34 aa, Artificial Sequence; identical to SEQ ID NO: 49
  Antimicrobial peptide sequence

SEQ ID NO: 670 - protein, 34 aa, Artificial Sequence
  Antimicrobial peptide sequence
GLARILLRWLFRFGDNNNNNGLVRILLRWLFRFG

SEQ ID NO: 671 - protein, 34 aa, Artificial Sequence
  Antimicrobial peptide sequence
GLARILLRWLFRFGDNNNNNGLARILLRLLFFRG

SEQ ID NO: 672 - protein, 34 aa, Artificial Sequence
  Antimicrobial peptide sequence
GLARILLRWLFRFGDNNNNNGLARILLRLLFRFG

SEQ ID NO: 673 - protein, 34 aa, Artificial Sequence
  Antimicrobial peptide sequence
GLARILLRWLFRFGDNNNNNGLVRILLRLLFRFG

SEQ ID NO: 674 - protein, 34 aa, Artificial Sequence
  Antimicrobial peptide sequence
GLARILLRWLFRFGDNNNNNSLVRILLRLLLRFG

SEQ ID NO: 675 - protein, 34 aa, Artificial Sequence
  Antimicrobial peptide sequence
GLARILLRWLFRFGDNNNNNGLVRILLRLLLRYG

SEQ ID NO: 676 - protein, 34 aa, Artificial Sequence
  Antimicrobial peptide sequence
GLARILLRWLFRFGDNNNNNGLAWILLRWLFFRG

SEQ ID NO: 677 - protein, 34 aa, Artificial Sequence
  Antimicrobial peptide sequence
GLARILLRWLFRFGDNNNNNGLVRILLRWLFFRG

SEQ ID NO: 678 - protein, 34 aa, Artificial Sequence
  Antimicrobial peptide sequence
GLARILLRWLFRFGDNNNNNGLLRILLRWLFFRG

SEQ ID NO: 679 - protein, 34 aa, Artificial Sequence
  Antimicrobial peptide sequence
GLARILLRWLFRFGDNNNNNGLPWILLRWLFRFG

SEQ ID NO: 680 - protein, 34 aa, Artificial Sequence
  Antimicrobial peptide sequence
GLARILLRWLFRFGDNNNNNGLLRILLRWLFRFG

SEQ ID NO: 681 - protein, 34 aa, Artificial Sequence
  Antimicrobial peptide sequence
GLARILLRWLFRFGDNNNNNGLPWILLRWLFRRG

SEQ ID NO: 682 - protein, 35 aa, Artificial Sequence
  Antimicrobial peptide sequence
GLARILLRWLFRFGDNNNNNNGLPWILLRWLFFRG

SEQ ID NO: 683 - protein, 35 aa, Artificial Sequence
  Antimicrobial peptide sequence
GLARILLRWLFRFGDNNNNNNGLARILLRWLFFRG

SEQ ID NO: 684 - protein, 35 aa, Artificial Sequence; identical to SEQ ID NO: 43
  Antimicrobial peptide sequence

SEQ ID NO: 685 - protein, 35 aa, Artificial Sequence
  Antimicrobial peptide sequence
GLARILLRWLFRFGDNNNNNNGLVRILLRWLFRFG

SEQ ID NO: 686 - protein, 35 aa, Artificial Sequence
  Antimicrobial peptide sequence
GLARILLRWLFRFGDNNNNNNGLARILLRLLFFRG

SEQ ID NO: 687 - protein, 35 aa, Artificial Sequence
  Antimicrobial peptide sequence
GLARILLRWLFRFGDNNNNNNGLARILLRLLFRFG

SEQ ID NO: 688 - protein, 35 aa, Artificial Sequence
  Antimicrobial peptide sequence
GLARILLRWLFRFGDNNNNNNGLVRILLRLLFRFG

SEQ ID NO: 689 - protein, 35 aa, Artificial Sequence
  Antimicrobial peptide sequence
GLARILLRWLFRFGDNNNNNNSLVRILLRLLLRFG

SEQ ID NO: 690 - protein, 35 aa, Artificial Sequence
  Antimicrobial peptide sequence
GLARILLRWLFRFGDNNNNNNGLVRILLRLLLRYG

SEQ ID NO: 691 - protein, 35 aa, Artificial Sequence
  Antimicrobial peptide sequence
GLARILLRWLFRFGDNNNNNNGLAWILLRWLFFRG

SEQ ID NO: 692 - protein, 35 aa, Artificial Sequence
  Antimicrobial peptide sequence
GLARILLRWLFRFGDNNNNNNGLVRILLRWLFFRG

SEQ ID NO: 693 - protein, 35 aa, Artificial Sequence
  Antimicrobial peptide sequence
GLARILLRWLFRFGDNNNNNNGLLRILLRWLFFRG

SEQ ID NO: 694 - protein, 35 aa, Artificial Sequence
  Antimicrobial peptide sequence
GLARILLRWLFRFGDNNNNNNGLPWILLRWLFRFG

SEQ ID NO: 695 - protein, 35 aa, Artificial Sequence
  Antimicrobial peptide sequence
GLARILLRWLFRFGDNNNNNNGLLRILLRWLFRFG

SEQ ID NO: 696 - protein, 35 aa, Artificial Sequence
  Antimicrobial peptide sequence
GLARILLRWLFRFGDNNNNNNGLPWILLRWLFRRG

SEQ ID NO: 697 - protein, 36 aa, Artificial Sequence
  Antimicrobial peptide sequence
GLARILLRWLFRFGDNNNNNNNGLPWILLRWLFFRG

SEQ ID NO: 698 - protein, 36 aa, Artificial Sequence
  Antimicrobial peptide sequence
GLARILLRWLFRFGDNNNNNNNGLARILLRWLFFRG

SEQ ID NO: 699 - protein, 36 aa, Artificial Sequence
  Antimicrobial peptide sequence
GLARILLRWLFRFGDNNNNNNNGLARILLRWLFRFG

SEQ ID NO: 700 - protein, 36 aa, Artificial Sequence
  Antimicrobial peptide sequence
GLARILLRWLFRFGDNNNNNNNGLVRILLRWLFRFG

SEQ ID NO: 701 - protein, 36 aa, Artificial Sequence
  Antimicrobial peptide sequence
GLARILLRWLFRFGDNNNNNNNGLARILLRLLFFRG

SEQ ID NO: 702 - protein, 36 aa, Artificial Sequence
  Antimicrobial peptide sequence
GLARILLRWLFRFGDNNNNNNNGLARILLRLLFRFG

SEQ ID NO: 703 - protein, 36 aa, Artificial Sequence
  Antimicrobial peptide sequence
GLARILLRWLFRFGDNNNNNNNGLVRILLRLLFRFG

SEQ ID NO: 704 - protein, 36 aa, Artificial Sequence
  Antimicrobial peptide sequence
GLARILLRWLFRFGDNNNNNNNSLVRILLRLLLRFG

SEQ ID NO: 705 - protein, 36 aa, Artificial Sequence
  Antimicrobial peptide sequence
GLARILLRWLFRFGDNNNNNNNGLVRILLRLLLRYG

SEQ ID NO: 706 - protein, 36 aa, Artificial Sequence
  Antimicrobial peptide sequence
GLARILLRWLFRFGDNNNNNNNGLAWILLRWLFFRG

SEQ ID NO: 707 - protein, 36 aa, Artificial Sequence
  Antimicrobial peptide sequence
GLARILLRWLFRFGDNNNNNNNGLVRILLRWLFFRG

SEQ ID NO: 708 - protein, 36 aa, Artificial Sequence
  Antimicrobial peptide sequence
GLARILLRWLFRFGDNNNNNNNGLLRILLRWLFFRG

SEQ ID NO: 709 - protein, 36 aa, Artificial Sequence
  Antimicrobial peptide sequence
GLARILLRWLFRFGDNNNNNNNGLPWILLRWLFRFG

SEQ ID NO: 710 - protein, 36 aa, Artificial Sequence
  Antimicrobial peptide sequence
GLARILLRWLFRFGDNNNNNNNGLLRILLRWLFRFG

SEQ ID NO: 711 - protein, 36 aa, Artificial Sequence
  Antimicrobial peptide sequence
GLARILLRWLFRFGDNNNNNNNGLPWILLRWLFRRG

SEQ ID NO: 712 - protein, 35 aa, Artificial Sequence
  Antimicrobial peptide sequence
GLARILLRWLFRFGDNGNGNGGLPWILLRWLFFRG

SEQ ID NO: 713 - protein, 35 aa, Artificial Sequence
  Antimicrobial peptide sequence
GLARILLRWLFRFGDNGNGNGGLARILLRWLFFRG

SEQ ID NO: 714 - protein, 35 aa, Artificial Sequence
  Antimicrobial peptide sequence
GLARILLRWLFRFGDNGNGNGGLARILLRWLFRFG

SEQ ID NO: 715 - protein, 35 aa, Artificial Sequence
  Antimicrobial peptide sequence
GLARILLRWLFRFGDNGNGNGGLVRILLRWLFRFG

SEQ ID NO: 716 - protein, 35 aa, Artificial Sequence
  Antimicrobial peptide sequence
GLARILLRWLFRFGDNGNGNGGLARILLRLLFFRG

SEQ ID NO: 717 - protein, 35 aa, Artificial Sequence
  Antimicrobial peptide sequence
GLARILLRWLFRFGDNGNGNGGLARILLRLLFRFG

SEQ ID NO: 718 - protein, 35 aa, Artificial Sequence
  Antimicrobial peptide sequence
GLARILLRWLFRFGDNGNGNGGLVRILLRLLFRFG

SEQ ID NO: 719 - protein, 35 aa, Artificial Sequence
  Antimicrobial peptide sequence
GLARILLRWLFRFGDNGNGNGSLVRILLRLLLRFG

SEQ ID NO: 720 - protein, 35 aa, Artificial Sequence
  Antimicrobial peptide sequence
GLARILLRWLFRFGDNGNGNGGLVRILLRLLLRYG

SEQ ID NO: 721 - protein, 35 aa, Artificial Sequence
  Antimicrobial peptide sequence
GLARILLRWLFRFGDNGNGNGGLAWILLRWLFFRG

SEQ ID NO: 722 - protein, 35 aa, Artificial Sequence
  Antimicrobial peptide sequence
GLARILLRWLFRFGDNGNGNGGLVRILLRWLFFRG

SEQ ID NO: 723 - protein, 35 aa, Artificial Sequence
  Antimicrobial peptide sequence
GLARILLRWLFRFGDNGNGNGGLLRILLRWLFFRG

SEQ ID NO: 724 - protein, 35 aa, Artificial Sequence
  Antimicrobial peptide sequence
GLARILLRWLFRFGDNGNGNGGLPWILLRWLFRFG

SEQ ID NO: 725 - protein, 35 aa, Artificial Sequence
  Antimicrobial peptide sequence
GLARILLRWLFRFGDNGNGNGGLLRILLRWLFRFG

SEQ ID NO: 726 - protein, 35 aa, Artificial Sequence
  Antimicrobial peptide sequence
GLARILLRWLFRFGDNGNGNGGLPWILLRWLFRRG

SEQ ID NO: 727 - protein, 35 aa, Artificial Sequence
  Antimicrobial peptide sequence
GLARILLRWLFRFGDGNGNGNGLPWILLRWLFFRG

SEQ ID NO: 728 - protein, 35 aa, Artificial Sequence
  Antimicrobial peptide sequence
GLARILLRWLFRFGDGNGNGNGLARILLRWLFFRG

SEQ ID NO: 729 - protein, 35 aa, Artificial Sequence
  Antimicrobial peptide sequence
GLARILLRWLFRFGDGNGNGNGLARILLRWLFRFG

SEQ ID NO: 730 - protein, 35 aa, Artificial Sequence
  Antimicrobial peptide sequence
GLARILLRWLFRFGDGNGNGNGLVRILLRWLFRFG

SEQ ID NO: 731 - protein, 35 aa, Artificial Sequence
  Antimicrobial peptide sequence
GLARILLRWLFRFGDGNGNGNGLARILLRLLFFRG

SEQ ID NO: 732 - protein, 35 aa, Artificial Sequence
  Antimicrobial peptide sequence
GLARILLRWLFRFGDGNGNGNGLARILLRLLFRFG

SEQ ID NO: 733 - protein, 35 aa, Artificial Sequence
  Antimicrobial peptide sequence
GLARILLRWLFRFGDGNGNGNGLVRILLRLLFRFG

SEQ ID NO: 734 - protein, 35 aa, Artificial Sequence
  Antimicrobial peptide sequence
GLARILLRWLFRFGDGNGNGNSLVRILLRLLLRFG

SEQ ID NO: 735 - protein, 35 aa, Artificial Sequence
  Antimicrobial peptide sequence
GLARILLRWLFRFGDGNGNGNGLVRILLRLLLRYG

SEQ ID NO: 736 - protein, 35 aa, Artificial Sequence
  Antimicrobial peptide sequence
GLARILLRWLFRFGDGNGNGNGLAWILLRWLFFRG

SEQ ID NO: 737 - protein, 35 aa, Artificial Sequence
  Antimicrobial peptide sequence
GLARILLRWLFRFGDGNGNGNGLVRILLRWLFFRG

SEQ ID NO: 738 - protein, 35 aa, Artificial Sequence
  Antimicrobial peptide sequence
GLARILLRWLFRFGDGNGNGNGLLRILLRWLFFRG

SEQ ID NO: 739 - protein, 35 aa, Artificial Sequence
  Antimicrobial peptide sequence
GLARILLRWLFRFGDGNGNGNGLPWILLRWLFRFG

SEQ ID NO: 740 - protein, 35 aa, Artificial Sequence
  Antimicrobial peptide sequence
GLARILLRWLFRFGDGNGNGNGLLRILLRWLFRFG

SEQ ID NO: 741 - protein, 35 aa, Artificial Sequence
  Antimicrobial peptide sequence
GLARILLRWLFRFGDGNGNGNGLPWILLRWLFRRG

SEQ ID NO: 742 - protein, 35 aa, Artificial Sequence
  Antimicrobial peptide sequence
GLARILLRWLFRFGDSGSGSGGLPWILLRWLFFRG

SEQ ID NO: 743 - protein, 35 aa, Artificial Sequence
  Antimicrobial peptide sequence
GLARILLRWLFRFGDSGSGSGGLARILLRWLFFRG

SEQ ID NO: 744 - protein, 35 aa, Artificial Sequence
  Antimicrobial peptide sequence
GLARILLRWLFRFGDSGSGSGGLARILLRWLFRFG

SEQ ID NO: 745 - protein, 35 aa, Artificial Sequence
  Antimicrobial peptide sequence
GLARILLRWLFRFGDSGSGSGGLVRILLRWLFRFG

SEQ ID NO: 746 - protein, 35 aa, Artificial Sequence
  Antimicrobial peptide sequence
GLARILLRWLFRFGDSGSGSGGLARILLRLLFFRG

SEQ ID NO: 747 - protein, 35 aa, Artificial Sequence
  Antimicrobial peptide sequence
GLARILLRWLFRFGDSGSGSGGLARILLRLLFRFG

SEQ ID NO: 748 - protein, 35 aa, Artificial Sequence
  Antimicrobial peptide sequence
GLARILLRWLFRFGDSGSGSGGLVRILLRLLFRFG

SEQ ID NO: 749 - protein, 35 aa, Artificial Sequence
  Antimicrobial peptide sequence
GLARILLRWLFRFGDSGSGSGSLVRILLRLLLRFG

SEQ ID NO: 750 - protein, 35 aa, Artificial Sequence
  Antimicrobial peptide sequence
GLARILLRWLFRFGDSGSGSGGLVRILLRLLLRYG

SEQ ID NO: 751 - protein, 35 aa, Artificial Sequence
  Antimicrobial peptide sequence
GLARILLRWLFRFGDSGSGSGGLAWILLRWLFFRG

SEQ ID NO: 752 - protein, 35 aa, Artificial Sequence
  Antimicrobial peptide sequence
GLARILLRWLFRFGDSGSGSGGLVRILLRWLFFRG

SEQ ID NO: 753 - protein, 35 aa, Artificial Sequence
  Antimicrobial peptide sequence
GLARILLRWLFRFGDSGSGSGGLLRILLRWLFFRG

SEQ ID NO: 754 - protein, 35 aa, Artificial Sequence
  Antimicrobial peptide sequence
GLARILLRWLFRFGDSGSGSGGLPWILLRWLFRFG

SEQ ID NO: 755 - protein, 35 aa, Artificial Sequence
  Antimicrobial peptide sequence
GLARILLRWLFRFGDSGSGSGGLLRILLRWLFRFG

SEQ ID NO: 756 - protein, 35 aa, Artificial Sequence
  Antimicrobial peptide sequence
GLARILLRWLFRFGDSGSGSGGLPWILLRWLFRRG

SEQ ID NO: 757 - protein, 35 aa, Artificial Sequence
  Antimicrobial peptide sequence
GLARILLRWLFRFGDGSGSGSGLPWILLRWLFFRG

SEQ ID NO: 758 - protein, 35 aa, Artificial Sequence
  Antimicrobial peptide sequence
GLARILLRWLFRFGDGSGSGSGLARILLRWLFFRG

SEQ ID NO: 759 - protein, 35 aa, Artificial Sequence
  Antimicrobial peptide sequence
GLARILLRWLFRFGDGSGSGSGLARILLRWLFRFG

SEQ ID NO: 760 - protein, 35 aa, Artificial Sequence
  Antimicrobial peptide sequence
GLARILLRWLFRFGDGSGSGSGLVRILLRWLFRFG

SEQ ID NO: 761 - protein, 35 aa, Artificial Sequence
  Antimicrobial peptide sequence
GLARILLRWLFRFGDGSGSGSGLARILLRLLFFRG

SEQ ID NO: 762 - protein, 35 aa, Artificial Sequence
  Antimicrobial peptide sequence
GLARILLRWLFRFGDGSGSGSGLARILLRLLFRFG

SEQ ID NO: 763 - protein, 35 aa, Artificial Sequence
  Antimicrobial peptide sequence
GLARILLRWLFRFGDGSGSGSGLVRILLRLLFRFG

SEQ ID NO: 764 - protein, 35 aa, Artificial Sequence
  Antimicrobial peptide sequence
GLARILLRWLFRFGDGSGSGSSLVRILLRLLLRFG

SEQ ID NO: 765 - protein, 35 aa, Artificial Sequence
  Antimicrobial peptide sequence
GLARILLRWLFRFGDGSGSGSGLVRILLRLLLRYG

SEQ ID NO: 766 - protein, 35 aa, Artificial Sequence
  Antimicrobial peptide sequence
GLARILLRWLFRFGDGSGSGSGLAWILLRWLFFRG

SEQ ID NO: 767 - protein, 35 aa, Artificial Sequence
  Antimicrobial peptide sequence
GLARILLRWLFRFGDGSGSGSGLVRILLRWLFFRG

SEQ ID NO: 768 - protein, 35 aa, Artificial Sequence
  Antimicrobial peptide sequence
GLARILLRWLFRFGDGSGSGSGLLRILLRWLFFRG

SEQ ID NO: 769 - protein, 35 aa, Artificial Sequence
  Antimicrobial peptide sequence
GLARILLRWLFRFGDGSGSGSGLPWILLRWLFRFG

SEQ ID NO: 770 - protein, 35 aa, Artificial Sequence
  Antimicrobial peptide sequence
GLARILLRWLFRFGDGSGSGSGLLRILLRWLFRFG

SEQ ID NO: 771 - protein, 35 aa, Artificial Sequence
  Antimicrobial peptide sequence
GLARILLRWLFRFGDGSGSGSGLPWILLRWLFRRG

SEQ ID NO: 772 - protein, 35 aa, Artificial Sequence
  Antimicrobial peptide sequence
GLARILLRWLFRFGDSNSNSNGLPWILLRWLFFRG

SEQ ID NO: 773 - protein, 35 aa, Artificial Sequence
  Antimicrobial peptide sequence
GLARILLRWLFRFGDSNSNSNGLARILLRWLFFRG

SEQ ID NO: 774 - protein, 35 aa, Artificial Sequence
  Antimicrobial peptide sequence
GLARILLRWLFRFGDSNSNSNGLARILLRWLFRFG

SEQ ID NO: 775 - protein, 35 aa, Artificial Sequence
  Antimicrobial peptide sequence
GLARILLRWLFRFGDSNSNSNGLVRILLRWLFRFG

SEQ ID NO: 776 - protein, 35 aa, Artificial Sequence
  Antimicrobial peptide sequence
GLARILLRWLFRFGDSNSNSNGLARILLRLLFFRG

SEQ ID NO: 777 - protein, 35 aa, Artificial Sequence
  Antimicrobial peptide sequence
GLARILLRWLFRFGDSNSNSNGLARILLRLLFRFG

SEQ ID NO: 778 - protein, 35 aa, Artificial Sequence
  Antimicrobial peptide sequence
GLARILLRWLFRFGDSNSNSNGLVRILLRLLFRFG

SEQ ID NO: 779 - protein, 35 aa, Artificial Sequence
  Antimicrobial peptide sequence
GLARILLRWLFRFGDSNSNSNSLVRILLRLLLRFG

SEQ ID NO: 780 - protein, 35 aa, Artificial Sequence
  Antimicrobial peptide sequence
GLARILLRWLFRFGDSNSNSNGLVRILLRLLLRYG

SEQ ID NO: 781 - protein, 35 aa, Artificial Sequence
  Antimicrobial peptide sequence
GLARILLRWLFRFGDSNSNSNGLAWILLRWLFFRG

SEQ ID NO: 782 - protein, 35 aa, Artificial Sequence
  Antimicrobial peptide sequence
GLARILLRWLFRFGDSNSNSNGLVRILLRWLFFRG

SEQ ID NO: 783 - protein, 35 aa, Artificial Sequence
  Antimicrobial peptide sequence
GLARILLRWLFRFGDSNSNSNGLLRILLRWLFFRG

SEQ ID NO: 784 - protein, 35 aa, Artificial Sequence
  Antimicrobial peptide sequence
GLARILLRWLFRFGDSNSNSNGLPWILLRWLFRFG

SEQ ID NO: 785 - protein, 35 aa, Artificial Sequence
  Antimicrobial peptide sequence
GLARILLRWLFRFGDSNSNSNGLLRILLRWLFRFG

SEQ ID NO: 786 - protein, 35 aa, Artificial Sequence
  Antimicrobial peptide sequence
GLARILLRWLFRFGDSNSNSNGLPWILLRWLFRRG

SEQ ID NO: 787 - protein, 35 aa, Artificial Sequence
  Antimicrobial peptide sequence
GLARILLRWLFRFGDNSNSNSGLPWILLRWLFFRG

SEQ ID NO: 788 - protein, 35 aa, Artificial Sequence
  Antimicrobial peptide sequence
GLARILLRWLFRFGDNSNSNSGLARILLRWLFFRG

SEQ ID NO: 789 - protein, 35 aa, Artificial Sequence
  Antimicrobial peptide sequence
GLARILLRWLFRFGDNSNSNSGLARILLRWLFRFG

SEQ ID NO: 790 - protein, 35 aa, Artificial Sequence
  Antimicrobial peptide sequence
GLARILLRWLFRFGDNSNSNSGLVRILLRWLFRFG

SEQ ID NO: 791 - protein, 35 aa, Artificial Sequence
  Antimicrobial peptide sequence
GLARILLRWLFRFGDNSNSNSGLARILLRLLFFRG

SEQ ID NO: 792 - protein, 35 aa, Artificial Sequence
  Antimicrobial peptide sequence
GLARILLRWLFRFGDNSNSNSGLARILLRLLFRFG

SEQ ID NO: 793 - protein, 35 aa, Artificial Sequence
  Antimicrobial peptide sequence
GLARILLRWLFRFGDNSNSNSGLVRILLRLLFRFG

SEQ ID NO: 794 - protein, 35 aa, Artificial Sequence
  Antimicrobial peptide sequence
GLARILLRWLFRFGDNSNSNSSLVRILLRLLLRFG

SEQ ID NO: 795 - protein, 35 aa, Artificial Sequence
  Antimicrobial peptide sequence
GLARILLRWLFRFGDNSNSNSGLVRILLRLLLRYG

SEQ ID NO: 796 - protein, 35 aa, Artificial Sequence
  Antimicrobial peptide sequence
GLARILLRWLFRFGDNSNSNSGLAWILLRWLFFRG

SEQ ID NO: 797 - protein, 35 aa, Artificial Sequence
  Antimicrobial peptide sequence
GLARILLRWLFRFGDNSNSNSGLVRILLRWLFFRG

SEQ ID NO: 798 - protein, 35 aa, Artificial Sequence
  Antimicrobial peptide sequence
GLARILLRWLFRFGDNSNSNSGLLRILLRWLFFRG

SEQ ID NO: 799 - protein, 35 aa, Artificial Sequence
  Antimicrobial peptide sequence
GLARILLRWLFRFGDNSNSNSGLPWILLRWLFRFG

SEQ ID NO: 800 - protein, 35 aa, Artificial Sequence
  Antimicrobial peptide sequence
GLARILLRWLFRFGDNSNSNSGLLRILLRWLFRFG

SEQ ID NO: 801 - protein, 35 aa, Artificial Sequence
  Antimicrobial peptide sequence
GLARILLRWLFRFGDNSNSNSGLPWILLRWLFRRG

SEQ ID NO: 802 - protein, 35 aa, Artificial Sequence
  Antimicrobial peptide sequence
GLARILLRWLFRFGDHGHGHGGLPWILLRWLFFRG

SEQ ID NO: 803 - protein, 35 aa, Artificial Sequence
  Antimicrobial peptide sequence
GLARILLRWLFRFGDHGHGHGGLARILLRWLFFRG

SEQ ID NO: 804 - protein, 35 aa, Artificial Sequence
  Antimicrobial peptide sequence
GLARILLRWLFRFGDHGHGHGGLARILLRWLFRFG

SEQ ID NO: 805 - protein, 35 aa, Artificial Sequence
  Antimicrobial peptide sequence
GLARILLRWLFRFGDHGHGHGGLVRILLRWLFRFG

SEQ ID NO: 806 - protein, 35 aa, Artificial Sequence
  Antimicrobial peptide sequence
GLARILLRWLFRFGDHGHGHGGLARILLRLLFFRG

SEQ ID NO: 807 - protein, 35 aa, Artificial Sequence
  Antimicrobial peptide sequence
GLARILLRWLFRFGDHGHGHGGLARILLRLLFRFG

SEQ ID NO: 808 - protein, 35 aa, Artificial Sequence
  Antimicrobial peptide sequence
GLARILLRWLFRFGDHGHGHGGLVRILLRLLFRFG

SEQ ID NO: 809 - protein, 35 aa, Artificial Sequence
  Antimicrobial peptide sequence
GLARILLRWLFRFGDHGHGHGSLVRILLRLLLRFG

SEQ ID NO: 810 - protein, 35 aa, Artificial Sequence
  Antimicrobial peptide sequence
GLARILLRWLFRFGDHGHGHGGLVRILLRLLLRYG

SEQ ID NO: 811 - protein, 35 aa, Artificial Sequence
  Antimicrobial peptide sequence
GLARILLRWLFRFGDHGHGHGGLAWILLRWLFFRG

SEQ ID NO: 812 - protein, 35 aa, Artificial Sequence
  Antimicrobial peptide sequence
GLARILLRWLFRFGDHGHGHGGLVRILLRWLFFRG

SEQ ID NO: 813 - protein, 35 aa, Artificial Sequence
  Antimicrobial peptide sequence
GLARILLRWLFRFGDHGHGHGGLLRILLRWLFFRG

SEQ ID NO: 814 - protein, 35 aa, Artificial Sequence
  Antimicrobial peptide sequence
GLARILLRWLFRFGDHGHGHGGLPWILLRWLFRFG

SEQ ID NO: 815 - protein, 35 aa, Artificial Sequence
  Antimicrobial peptide sequence
GLARILLRWLFRFGDHGHGHGGLLRILLRWLFRFG

SEQ ID NO: 816 - protein, 35 aa, Artificial Sequence
  Antimicrobial peptide sequence
GLARILLRWLFRFGDHGHGHGGLPWILLRWLFRRG

SEQ ID NO: 817 - protein, 35 aa, Artificial Sequence
  Antimicrobial peptide sequence
GLARILLRWLFRFGDGHGHGHGLPWILLRWLFFRG

SEQ ID NO: 818 - protein, 35 aa, Artificial Sequence
  Antimicrobial peptide sequence
GLARILLRWLFRFGDGHGHGHGLARILLRWLFFRG

SEQ ID NO: 819 - protein, 35 aa, Artificial Sequence
  Antimicrobial peptide sequence
GLARILLRWLFRFGDGHGHGHGLARILLRWLFRFG

SEQ ID NO: 820 - protein, 35 aa, Artificial Sequence
  Antimicrobial peptide sequence
GLARILLRWLFRFGDGHGHGHGLVRILLRWLFRFG

SEQ ID NO: 821 - protein, 35 aa, Artificial Sequence
  Antimicrobial peptide sequence
GLARILLRWLFRFGDGHGHGHGLARILLRLLFFRG

SEQ ID NO: 822 - protein, 35 aa, Artificial Sequence
  Antimicrobial peptide sequence
GLARILLRWLFRFGDGHGHGHGLARILLRLLFRFG

SEQ ID NO: 823 - protein, 35 aa, Artificial Sequence
  Antimicrobial peptide sequence
GLARILLRWLFRFGDGHGHGHGLVRILLRLLFRFG

SEQ ID NO: 824 - protein, 35 aa, Artificial Sequence
  Antimicrobial peptide sequence
GLARILLRWLFRFGDGHGHGHSLVRILLRLLLRFG

SEQ ID NO: 825 - protein, 35 aa, Artificial Sequence
  Antimicrobial peptide sequence
GLARILLRWLFRFGDGHGHGHGLVRILLRLLLRYG

SEQ ID NO: 826 - protein, 35 aa, Artificial Sequence
  Antimicrobial peptide sequence
GLARILLRWLFRFGDGHGHGHGLAWILLRWLFFRG

SEQ ID NO: 827 - protein, 35 aa, Artificial Sequence
  Antimicrobial peptide sequence
GLARILLRWLFRFGDGHGHGHGLVRILLRWLFFRG

SEQ ID NO: 828 - protein, 35 aa, Artificial Sequence
  Antimicrobial peptide sequence
GLARILLRWLFRFGDGHGHGHGLLRILLRWLFFRG

SEQ ID NO: 829 - protein, 35 aa, Artificial Sequence
  Antimicrobial peptide sequence
GLARILLRWLFRFGDGHGHGHGLPWILLRWLFRFG

SEQ ID NO: 830 - protein, 35 aa, Artificial Sequence
  Antimicrobial peptide sequence
GLARILLRWLFRFGDGHGHGHGLLRILLRWLFRFG

SEQ ID NO: 831 - protein, 35 aa, Artificial Sequence
  Antimicrobial peptide sequence
GLARILLRWLFRFGDGHGHGHGLPWILLRWLFRRG

SEQ ID NO: 832 - protein, 35 aa, Artificial Sequence
  Antimicrobial peptide sequence
GLARILLRWLFRFGDHNHNHNGLPWILLRWLFFRG

SEQ ID NO: 833 - protein, 35 aa, Artificial Sequence
  Antimicrobial peptide sequence
GLARILLRWLFRFGDHNHNHNGLARILLRWLFFRG

SEQ ID NO: 834 - protein, 35 aa, Artificial Sequence
  Antimicrobial peptide sequence
GLARILLRWLFRFGDHNHNHNGLARILLRWLFRFG

SEQ ID NO: 835 - protein, 35 aa, Artificial Sequence
  Antimicrobial peptide sequence
GLARILLRWLFRFGDHNHNHNGLVRILLRWLFRFG

SEQ ID NO: 836 - protein, 35 aa, Artificial Sequence
  Antimicrobial peptide sequence
GLARILLRWLFRFGDHNHNHNGLARILLRLLFFRG

SEQ ID NO: 837 - protein, 35 aa, Artificial Sequence
  Antimicrobial peptide sequence
GLARILLRWLFRFGDHNHNHNGLARILLRLLFRFG

SEQ ID NO: 838 - protein, 35 aa, Artificial Sequence
  Antimicrobial peptide sequence
GLARILLRWLFRFGDHNHNHNGLVRILLRLLFRFG

SEQ ID NO: 839 - protein, 35 aa, Artificial Sequence
  Antimicrobial peptide sequence
GLARILLRWLFRFGDHNHNHNSLVRILLRLLLRFG

SEQ ID NO: 840 - protein, 35 aa, Artificial Sequence
  Antimicrobial peptide sequence
GLARILLRWLFRFGDHNHNHNGLVRILLRLLLRYG

SEQ ID NO: 841 - protein, 35 aa, Artificial Sequence
  Antimicrobial peptide sequence
GLARILLRWLFRFGDHNHNHNGLAWILLRWLFFRG

SEQ ID NO: 842 - protein, 35 aa, Artificial Sequence
  Antimicrobial peptide sequence
GLARILLRWLFRFGDHNHNHNGLVRILLRWLFFRG

SEQ ID NO: 843 - protein, 35 aa, Artificial Sequence
  Antimicrobial peptide sequence
GLARILLRWLFRFGDHNHNHNGLLRILLRWLFFRG

SEQ ID NO: 844 - protein, 35 aa, Artificial Sequence
  Antimicrobial peptide sequence
GLARILLRWLFRFGDHNHNHNGLPWILLRWLFRFG

SEQ ID NO: 845 - protein, 35 aa, Artificial Sequence
  Antimicrobial peptide sequence
GLARILLRWLFRFGDHNHNHNGLLRILLRWLFRFG

SEQ ID NO: 846 - protein, 35 aa, Artificial Sequence
  Antimicrobial peptide sequence
GLARILLRWLFRFGDHNHNHNGLPWILLRWLFRRG

SEQ ID NO: 847 - protein, 35 aa, Artificial Sequence
  Antimicrobial peptide sequence
GLARILLRWLFRFGDNHNHNHGLPWILLRWLFFRG

SEQ ID NO: 848 - protein, 35 aa, Artificial Sequence
  Antimicrobial peptide sequence
GLARILLRWLFRFGDNHNHNHGLARILLRWLFFRG

SEQ ID NO: 849 - protein, 35 aa, Artificial Sequence
  Antimicrobial peptide sequence
GLARILLRWLFRFGDNHNHNHGLARILLRWLFRFG

SEQ ID NO: 850 - protein, 35 aa, Artificial Sequence
  Antimicrobial peptide sequence
GLARILLRWLFRFGDNHNHNHGLVRILLRWLFRFG

SEQ ID NO: 851 - protein, 35 aa, Artificial Sequence
  Antimicrobial peptide sequence
GLARILLRWLFRFGDNHNHNHGLARILLRLLFFRG

SEQ ID NO: 852 - protein, 35 aa, Artificial Sequence
  Antimicrobial peptide sequence
GLARILLRWLFRFGDNHNHNHGLARILLRLLFRFG

SEQ ID NO: 853 - protein, 35 aa, Artificial Sequence
  Antimicrobial peptide sequence
GLARILLRWLFRFGDNHNHNHGLVRILLRLLFRFG

SEQ ID NO: 854 - protein, 35 aa, Artificial Sequence
  Antimicrobial peptide sequence
GLARILLRWLFRFGDNHNHNHSLVRILLRLLLRFG

SEQ ID NO: 855 - protein, 35 aa, Artificial Sequence
  Antimicrobial peptide sequence
GLARILLRWLFRFGDNHNHNHGLVRILLRLLLRYG

SEQ ID NO: 856 - protein, 35 aa, Artificial Sequence
  Antimicrobial peptide sequence
GLARILLRWLFRFGDNHNHNHGLAWILLRWLFFRG

SEQ ID NO: 857 - protein, 35 aa, Artificial Sequence
  Antimicrobial peptide sequence
GLARILLRWLFRFGDNHNHNHGLVRILLRWLFFRG

SEQ ID NO: 858 - protein, 35 aa, Artificial Sequence
  Antimicrobial peptide sequence
GLARILLRWLFRFGDNHNHNHGLLRILLRWLFFRG

SEQ ID NO: 859 - protein, 35 aa, Artificial Sequence
  Antimicrobial peptide sequence
GLARILLRWLFRFGDNHNHNHGLPWILLRWLFRFG

SEQ ID NO: 860 - protein, 35 aa, Artificial Sequence
  Antimicrobial peptide sequence
GLARILLRWLFRFGDNHNHNHGLLRILLRWLFRFG

SEQ ID NO: 861 - protein, 35 aa, Artificial Sequence
  Antimicrobial peptide sequence
GLARILLRWLFRFGDNHNHNHGLPWILLRWLFRRG

SEQ ID NO: 862 - protein, 33 aa, Artificial Sequence
  Antimicrobial peptide sequence
GLVRILLRWLFRFGDGGGGGLPWILLRWLFFRG

SEQ ID NO: 863 - protein, 33 aa, Artificial Sequence
  Antimicrobial peptide sequence
GLVRILLRWLFRFGDGGGGGLARILLRWLFFRG

SEQ ID NO: 864 - protein, 33 aa, Artificial Sequence
  Antimicrobial peptide sequence
GLVRILLRWLFRFGDGGGGGLARILLRWLFRFG

SEQ ID NO: 865 - protein, 33 aa, Artificial Sequence
  Antimicrobial peptide sequence
GLVRILLRWLFRFGDGGGGGLVRILLRWLFRFG

SEQ ID NO: 866 - protein, 33 aa, Artificial Sequence
  Antimicrobial peptide sequence
GLVRILLRWLFRFGDGGGGGLARILLRLLFFRG

SEQ ID NO: 867 - protein, 33 aa, Artificial Sequence
  Antimicrobial peptide sequence
GLVRILLRWLFRFGDGGGGGLARILLRLLFRFG

SEQ ID NO: 868 - protein, 33 aa, Artificial Sequence
  Antimicrobial peptide sequence
GLVRILLRWLFRFGDGGGGGLVRILLRLLFRFG

SEQ ID NO: 869 - protein, 33 aa, Artificial Sequence
  Antimicrobial peptide sequence
GLVRILLRWLFRFGDGGGGSLVRILLRLLLRFG

SEQ ID NO: 870 - protein, 33 aa, Artificial Sequence
  Antimicrobial peptide sequence
GLVRILLRWLFRFGDGGGGGLVRILLRLLLRYG

SEQ ID NO: 871 - protein, 33 aa, Artificial Sequence
  Antimicrobial peptide sequence
GLVRILLRWLFRFGDGGGGGLAWILLRWLFFRG

SEQ ID NO: 872 - protein, 33 aa, Artificial Sequence
  Antimicrobial peptide sequence
GLVRILLRWLFRFGDGGGGGLVRILLRWLFFRG

SEQ ID NO: 873 - protein, 33 aa, Artificial Sequence
  Antimicrobial peptide sequence
GLVRILLRWLFRFGDGGGGGLLRILLRWLFFRG

SEQ ID NO: 874 - protein, 33 aa, Artificial Sequence
  Antimicrobial peptide sequence
GLVRILLRWLFRFGDGGGGGLPWILLRWLFRFG

SEQ ID NO: 875 - protein, 33 aa, Artificial Sequence
  Antimicrobial peptide sequence
GLVRILLRWLFRFGDGGGGGLLRILLRWLFRFG

SEQ ID NO: 876 - protein, 33 aa, Artificial Sequence
  Antimicrobial peptide sequence
GLVRILLRWLFRFGDGGGGGLPWILLRWLFRRG

SEQ ID NO: 877 - protein, 34 aa, Artificial Sequence
  Antimicrobial peptide sequence
GLVRILLRWLFRFGDGGGGGGLPWILLRWLFFRG

SEQ ID NO: 878 - protein, 34 aa, Artificial Sequence
  Antimicrobial peptide sequence
GLVRILLRWLFRFGDGGGGGGLARILLRWLFFRG

SEQ ID NO: 879 - protein, 34 aa, Artificial Sequence
  Antimicrobial peptide sequence
GLVRILLRWLFRFGDGGGGGGLARILLRWLFRFG

SEQ ID NO: 880 - protein, 34 aa, Artificial Sequence
  Antimicrobial peptide sequence
GLVRILLRWLFRFGDGGGGGGLVRILLRWLFRFG

SEQ ID NO: 881 - protein, 34 aa, Artificial Sequence
  Antimicrobial peptide sequence
GLVRILLRWLFRFGDGGGGGGLARILLRLLFFRG

SEQ ID NO: 882 - protein, 34 aa, Artificial Sequence
  Antimicrobial peptide sequence
GLVRILLRWLFRFGDGGGGGGLARILLRLLFRFG

SEQ ID NO: 883 - protein, 34 aa, Artificial Sequence
  Antimicrobial peptide sequence
GLVRILLRWLFRFGDGGGGGGLVRILLRLLFRFG

SEQ ID NO: 884 - protein, 34 aa, Artificial Sequence
  Antimicrobial peptide sequence
GLVRILLRWLFRFGDGGGGGSLVRILLRLLLRFG

SEQ ID NO: 885 - protein, 34 aa, Artificial Sequence
  Antimicrobial peptide sequence
GLVRILLRWLFRFGDGGGGGGLVRILLRLLLRYG

SEQ ID NO: 886 - protein, 34 aa, Artificial Sequence
  Antimicrobial peptide sequence
GLVRILLRWLFRFGDGGGGGGLAWILLRWLFFRG

SEQ ID NO: 887 - protein, 34 aa, Artificial Sequence
  Antimicrobial peptide sequence
GLVRILLRWLFRFGDGGGGGGLVRILLRWLFFRG

SEQ ID NO: 888 - protein, 34 aa, Artificial Sequence
  Antimicrobial peptide sequence
GLVRILLRWLFRFGDGGGGGGLLRILLRWLFFRG

SEQ ID NO: 889 - protein, 34 aa, Artificial Sequence
  Antimicrobial peptide sequence
GLVRILLRWLFRFGDGGGGGGLPWILLRWLFRFG

SEQ ID NO: 890 - protein, 34 aa, Artificial Sequence
  Antimicrobial peptide sequence
GLVRILLRWLFRFGDGGGGGGLLRILLRWLFRFG

SEQ ID NO: 891 - protein, 34 aa, Artificial Sequence
  Antimicrobial peptide sequence
GLVRILLRWLFRFGDGGGGGGLPWILLRWLFRRG

SEQ ID NO: 892 - protein, 35 aa, Artificial Sequence
  Antimicrobial peptide sequence
GLVRILLRWLFRFGDGGGGGGGLPWILLRWLFFRG

SEQ ID NO: 893 - protein, 35 aa, Artificial Sequence
  Antimicrobial peptide sequence
GLVRILLRWLFRFGDGGGGGGGLARILLRWLFFRG

SEQ ID NO: 894 - protein, 35 aa, Artificial Sequence
  Antimicrobial peptide sequence
GLVRILLRWLFRFGDGGGGGGGLARILLRWLFRFG

SEQ ID NO: 895 - protein, 35 aa, Artificial Sequence
  Antimicrobial peptide sequence
GLVRILLRWLFRFGDGGGGGGGLVRILLRWLFRFG

SEQ ID NO: 896 - protein, 35 aa, Artificial Sequence
  Antimicrobial peptide sequence
GLVRILLRWLFRFGDGGGGGGGLARILLRLLFFRG

SEQ ID NO: 897 - protein, 35 aa, Artificial Sequence
  Antimicrobial peptide sequence
GLVRILLRWLFRFGDGGGGGGGLARILLRLLFRFG

SEQ ID NO: 898 - protein, 35 aa, Artificial Sequence
  Antimicrobial peptide sequence
GLVRILLRWLFRFGDGGGGGGGLVRILLRLLFRFG

SEQ ID NO: 899 - protein, 35 aa, Artificial Sequence
  Antimicrobial peptide sequence
GLVRILLRWLFRFGDGGGGGGSLVRILLRLLLRFG

SEQ ID NO: 900 - protein, 35 aa, Artificial Sequence
  Antimicrobial peptide sequence
GLVRILLRWLFRFGDGGGGGGGLVRILLRLLLRYG

SEQ ID NO: 901 - protein, 35 aa, Artificial Sequence
  Antimicrobial peptide sequence
GLVRILLRWLFRFGDGGGGGGGLAWILLRWLFFRG

SEQ ID NO: 902 - protein, 35 aa, Artificial Sequence
  Antimicrobial peptide sequence
GLVRILLRWLFRFGDGGGGGGGLVRILLRWLFFRG

SEQ ID NO: 903 - protein, 35 aa, Artificial Sequence
  Antimicrobial peptide sequence
GLVRILLRWLFRFGDGGGGGGGLLRILLRWLFFRG

SEQ ID NO: 904 - protein, 35 aa, Artificial Sequence
  Antimicrobial peptide sequence
GLVRILLRWLFRFGDGGGGGGGLPWILLRWLFRFG

SEQ ID NO: 905 - protein, 35 aa, Artificial Sequence
  Antimicrobial peptide sequence
GLVRILLRWLFRFGDGGGGGGGLLRILLRWLFRFG

SEQ ID NO: 906 - protein, 35 aa, Artificial Sequence
  Antimicrobial peptide sequence
GLVRILLRWLFRFGDGGGGGGGLPWILLRWLFRRG

SEQ ID NO: 907 - protein, 36 aa, Artificial Sequence
  Antimicrobial peptide sequence
GLVRILLRWLFRFGDGGGGGGGGLPWILLRWLFFRG

SEQ ID NO: 908 - protein, 36 aa, Artificial Sequence
  Antimicrobial peptide sequence
GLVRILLRWLFRFGDGGGGGGGGLARILLRWLFFRG

SEQ ID NO: 909 - protein, 36 aa, Artificial Sequence
  Antimicrobial peptide sequence
GLVRILLRWLFRFGDGGGGGGGGLARILLRWLFRFG

SEQ ID NO: 910 - protein, 36 aa, Artificial Sequence
  Antimicrobial peptide sequence
GLVRILLRWLFRFGDGGGGGGGGLVRILLRWLFRFG

SEQ ID NO: 911 - protein, 36 aa, Artificial Sequence
  Antimicrobial peptide sequence
GLVRILLRWLFRFGDGGGGGGGGLARILLRLLFFRG

SEQ ID NO: 912 - protein, 36 aa, Artificial Sequence
  Antimicrobial peptide sequence
GLVRILLRWLFRFGDGGGGGGGGLARILLRLLFRFG

SEQ ID NO: 913 - protein, 36 aa, Artificial Sequence
  Antimicrobial peptide sequence
GLVRILLRWLFRFGDGGGGGGGGLVRILLRLLFRFG

SEQ ID NO: 914 - protein, 36 aa, Artificial Sequence
  Antimicrobial peptide sequence
GLVRILLRWLFRFGDGGGGGGGSLVRILLRLLLRFG

SEQ ID NO: 915 - protein, 36 aa, Artificial Sequence
  Antimicrobial peptide sequence
GLVRILLRWLFRFGDGGGGGGGGLVRILLRLLLRYG

SEQ ID NO: 916 - protein, 36 aa, Artificial Sequence
  Antimicrobial peptide sequence
GLVRILLRWLFRFGDGGGGGGGGLAWILLRWLFFRG

SEQ ID NO: 917 - protein, 36 aa, Artificial Sequence
  Antimicrobial peptide sequence
GLVRILLRWLFRFGDGGGGGGGGLVRILLRWLFFRG

SEQ ID NO: 918 - protein, 36 aa, Artificial Sequence
  Antimicrobial peptide sequence
GLVRILLRWLFRFGDGGGGGGGGLLRILLRWLFFRG

SEQ ID NO: 919 - protein, 36 aa, Artificial Sequence
  Antimicrobial peptide sequence
GLVRILLRWLFRFGDGGGGGGGGLPWILLRWLFRFG

SEQ ID NO: 920 - protein, 36 aa, Artificial Sequence
  Antimicrobial peptide sequence
GLVRILLRWLFRFGDGGGGGGGGLLRILLRWLFRFG

SEQ ID NO: 921 - protein, 36 aa, Artificial Sequence
  Antimicrobial peptide sequence
GLVRILLRWLFRFGDGGGGGGGGLPWILLRWLFRRG

SEQ ID NO: 922 - protein, 33 aa, Artificial Sequence
  Antimicrobial peptide sequence
GLVRILLRWLFRFGDNNNNGLPWILLRWLFFRG

SEQ ID NO: 923 - protein, 33 aa, Artificial Sequence
  Antimicrobial peptide sequence
GLVRILLRWLFRFGDNNNNGLARILLRWLFFRG

SEQ ID NO: 924 - protein, 33 aa, Artificial Sequence
  Antimicrobial peptide sequence
GLVRILLRWLFRFGDNNNNGLARILLRWLFRFG

SEQ ID NO: 925 - protein, 33 aa, Artificial Sequence
  Antimicrobial peptide sequence
GLVRILLRWLFRFGDNNNNGLVRILLRWLFRFG

SEQ ID NO: 926 - protein, 33 aa, Artificial Sequence
  Antimicrobial peptide sequence
GLVRILLRWLFRFGDNNNNGLARILLRLLFFRG

SEQ ID NO: 927 - protein, 33 aa, Artificial Sequence
  Antimicrobial peptide sequence
GLVRILLRWLFRFGDNNNNGLARILLRLLFRFG

SEQ ID NO: 928 - protein, 33 aa, Artificial Sequence
  Antimicrobial peptide sequence
GLVRILLRWLFRFGDNNNNGLVRILLRLLFRFG

SEQ ID NO: 929 - protein, 33 aa, Artificial Sequence
  Antimicrobial peptide sequence
GLVRILLRWLFRFGDNNNNSLVRILLRLLLRFG

SEQ ID NO: 930 - protein, 33 aa, Artificial Sequence
  Antimicrobial peptide sequence
GLVRILLRWLFRFGDNNNNGLVRILLRLLLRYG

SEQ ID NO: 931 - protein, 33 aa, Artificial Sequence
  Antimicrobial peptide sequence
GLVRILLRWLFRFGDNNNNGLAWILLRWLFFRG

SEQ ID NO: 932 - protein, 33 aa, Artificial Sequence
  Antimicrobial peptide sequence
GLVRILLRWLFRFGDNNNNGLVRILLRWLFFRG

SEQ ID NO: 933 - protein, 33 aa, Artificial Sequence
  Antimicrobial peptide sequence
GLVRILLRWLFRFGDNNNNGLLRILLRWLFFRG

SEQ ID NO: 934 - protein, 33 aa, Artificial Sequence
  Antimicrobial peptide sequence
GLVRILLRWLFRFGDNNNNGLPWILLRWLFRFG

SEQ ID NO: 935 - protein, 33 aa, Artificial Sequence
  Antimicrobial peptide sequence
GLVRILLRWLFRFGDNNNNGLLRILLRWLFRFG

SEQ ID NO: 936 - protein, 33 aa, Artificial Sequence
  Antimicrobial peptide sequence
GLVRILLRWLFRFGDNNNNGLPWILLRWLFRRG

SEQ ID NO: 937 - protein, 34 aa, Artificial Sequence
  Antimicrobial peptide sequence
GLVRILLRWLFRFGDNNNNNGLPWILLRWLFFRG

SEQ ID NO: 938 - protein, 34 aa, Artificial Sequence
  Antimicrobial peptide sequence
GLVRILLRWLFRFGDNNNNNGLARILLRWLFFRG

SEQ ID NO: 939 - protein, 34 aa, Artificial Sequence
  Antimicrobial peptide sequence
GLVRILLRWLFRFGDNNNNNGLARILLRWLFRFG

SEQ ID NO: 940 - protein, 34 aa, Artificial Sequence
  Antimicrobial peptide sequence
GLVRILLRWLFRFGDNNNNNGLVRILLRWLFRFG

SEQ ID NO: 941 - protein, 34 aa, Artificial Sequence
  Antimicrobial peptide sequence
GLVRILLRWLFRFGDNNNNNGLARILLRLLFFRG

SEQ ID NO: 942 - protein, 34 aa, Artificial Sequence
  Antimicrobial peptide sequence
GLVRILLRWLFRFGDNNNNNGLARILLRLLFRFG

SEQ ID NO: 943 - protein, 34 aa, Artificial Sequence
  Antimicrobial peptide sequence
GLVRILLRWLFRFGDNNNNNGLVRILLRLLFRFG

SEQ ID NO: 944 - protein, 34 aa, Artificial Sequence
  Antimicrobial peptide sequence
GLVRILLRWLFRFGDNNNNNSLVRILLRLLLRFG

SEQ ID NO: 945 - protein, 34 aa, Artificial Sequence
  Antimicrobial peptide sequence
GLVRILLRWLFRFGDNNNNNGLVRILLRLLLRYG

SEQ ID NO: 946 - protein, 34 aa, Artificial Sequence
  Antimicrobial peptide sequence
GLVRILLRWLFRFGDNNNNNGLAWILLRWLFFRG

SEQ ID NO: 947 - protein, 34 aa, Artificial Sequence
  Antimicrobial peptide sequence
GLVRILLRWLFRFGDNNNNNGLVRILLRWLFFRG

SEQ ID NO: 948 - protein, 34 aa, Artificial Sequence
  Antimicrobial peptide sequence
GLVRILLRWLFRFGDNNNNNGLLRILLRWLFFRG

SEQ ID NO: 949 - protein, 34 aa, Artificial Sequence
  Antimicrobial peptide sequence
GLVRILLRWLFRFGDNNNNNGLPWILLRWLFRFG

SEQ ID NO: 950 - protein, 34 aa, Artificial Sequence
  Antimicrobial peptide sequence
GLVRILLRWLFRFGDNNNNNGLLRILLRWLFRFG

SEQ ID NO: 951 - protein, 34 aa, Artificial Sequence
  Antimicrobial peptide sequence
GLVRILLRWLFRFGDNNNNNGLPWILLRWLFRRG

SEQ ID NO: 952 - protein, 35 aa, Artificial Sequence
  Antimicrobial peptide sequence
GLVRILLRWLFRFGDNNNNNNGLPWILLRWLFFRG

SEQ ID NO: 953 - protein, 35 aa, Artificial Sequence
  Antimicrobial peptide sequence
GLVRILLRWLFRFGDNNNNNNGLARILLRWLFFRG

SEQ ID NO: 954 - protein, 35 aa, Artificial Sequence
  Antimicrobial peptide sequence
GLVRILLRWLFRFGDNNNNNNGLARILLRWLFRFG

SEQ ID NO: 955 - protein, 35 aa, Artificial Sequence
  Antimicrobial peptide sequence
GLVRILLRWLFRFGDNNNNNNGLVRILLRWLFRFG

SEQ ID NO: 956 - protein, 35 aa, Artificial Sequence
  Antimicrobial peptide sequence
GLVRILLRWLFRFGDNNNNNNGLARILLRLLFFRG

SEQ ID NO: 957 - protein, 35 aa, Artificial Sequence
  Antimicrobial peptide sequence
GLVRILLRWLFRFGDNNNNNNGLARILLRLLFRFG

SEQ ID NO: 958 - protein, 35 aa, Artificial Sequence
  Antimicrobial peptide sequence
GLVRILLRWLFRFGDNNNNNNGLVRILLRLLFRFG

SEQ ID NO: 959 - protein, 35 aa, Artificial Sequence
  Antimicrobial peptide sequence
GLVRILLRWLFRFGDNNNNNNSLVRILLRLLLRFG

SEQ ID NO: 960 - protein, 35 aa, Artificial Sequence
  Antimicrobial peptide sequence
GLVRILLRWLFRFGDNNNNNNGLVRILLRLLLRYG

SEQ ID NO: 961 - protein, 35 aa, Artificial Sequence
  Antimicrobial peptide sequence
GLVRILLRWLFRFGDNNNNNNGLAWILLRWLFFRG

SEQ ID NO: 962 - protein, 35 aa, Artificial Sequence
  Antimicrobial peptide sequence
GLVRILLRWLFRFGDNNNNNNGLVRILLRWLFFRG

SEQ ID NO: 963 - protein, 35 aa, Artificial Sequence
  Antimicrobial peptide sequence
GLVRILLRWLFRFGDNNNNNNGLLRILLRWLFFRG

SEQ ID NO: 964 - protein, 35 aa, Artificial Sequence
  Antimicrobial peptide sequence
GLVRILLRWLFRFGDNNNNNNGLPWILLRWLFRFG

SEQ ID NO: 965 - protein, 35 aa, Artificial Sequence
  Antimicrobial peptide sequence
GLVRILLRWLFRFGDNNNNNNGLLRILLRWLFRFG

SEQ ID NO: 966 - protein, 35 aa, Artificial Sequence
  Antimicrobial peptide sequence
GLVRILLRWLFRFGDNNNNNNGLPWILLRWLFRRG

SEQ ID NO: 967 - protein, 36 aa, Artificial Sequence
  Antimicrobial peptide sequence
GLVRILLRWLFRFGDNNNNNNNGLPWILLRWLFFRG

SEQ ID NO: 968 - protein, 36 aa, Artificial Sequence
  Antimicrobial peptide sequence
GLVRILLRWLFRFGDNNNNNNNGLARILLRWLFFRG

SEQ ID NO: 969 - protein, 36 aa, Artificial Sequence
  Antimicrobial peptide sequence
GLVRILLRWLFRFGDNNNNNNNGLARILLRWLFRFG

SEQ ID NO: 970 - protein, 36 aa, Artificial Sequence
  Antimicrobial peptide sequence
GLVRILLRWLFRFGDNNNNNNNGLVRILLRWLFRFG

SEQ ID NO: 971 - protein, 36 aa, Artificial Sequence
  Antimicrobial peptide sequence
GLVRILLRWLFRFGDNNNNNNNGLARILLRLLFFRG

SEQ ID NO: 972 - protein, 36 aa, Artificial Sequence
  Antimicrobial peptide sequence
GLVRILLRWLFRFGDNNNNNNNGLARILLRLLFRFG

SEQ ID NO: 973 - protein, 36 aa, Artificial Sequence
  Antimicrobial peptide sequence
GLVRILLRWLFRFGDNNNNNNNGLVRILLRLLFRFG

SEQ ID NO: 974 - protein, 36 aa, Artificial Sequence
  Antimicrobial peptide sequence
GLVRILLRWLFRFGDNNNNNNNSLVRILLRLLLRFG

SEQ ID NO: 975 - protein, 36 aa, Artificial Sequence
  Antimicrobial peptide sequence
GLVRILLRWLFRFGDNNNNNNNGLVRILLRLLLRYG

SEQ ID NO: 976 - protein, 36 aa, Artificial Sequence
  Antimicrobial peptide sequence
GLVRILLRWLFRFGDNNNNNNNGLAWILLRWLFFRG

SEQ ID NO: 977 - protein, 36 aa, Artificial Sequence
  Antimicrobial peptide sequence
GLVRILLRWLFRFGDNNNNNNNGLVRILLRWLFFRG

SEQ ID NO: 978 - protein, 36 aa, Artificial Sequence
  Antimicrobial peptide sequence
GLVRILLRWLFRFGDNNNNNNNGLLRILLRWLFFRG

SEQ ID NO: 979 - protein, 36 aa, Artificial Sequence
  Antimicrobial peptide sequence
GLVRILLRWLFRFGDNNNNNNNGLPWILLRWLFRFG

SEQ ID NO: 980 - protein, 36 aa, Artificial Sequence
  Antimicrobial peptide sequence
GLVRILLRWLFRFGDNNNNNNNGLLRILLRWLFRFG

SEQ ID NO: 981 - protein, 36 aa, Artificial Sequence
  Antimicrobial peptide sequence
GLVRILLRWLFRFGDNNNNNNNGLPWILLRWLFRRG

SEQ ID NO: 982 - protein, 35 aa, Artificial Sequence
  Antimicrobial peptide sequence
GLVRILLRWLFRFGDNGNGNGGLPWILLRWLFFRG

SEQ ID NO: 983 - protein, 35 aa, Artificial Sequence
  Antimicrobial peptide sequence
GLVRILLRWLFRFGDNGNGNGGLARILLRWLFFRG

SEQ ID NO: 984 - protein, 35 aa, Artificial Sequence
  Antimicrobial peptide sequence
GLVRILLRWLFRFGDNGNGNGGLARILLRWLFRFG

SEQ ID NO: 985 - protein, 35 aa, Artificial Sequence
  Antimicrobial peptide sequence
GLVRILLRWLFRFGDNGNGNGGLVRILLRWLFRFG

SEQ ID NO: 986 - protein, 35 aa, Artificial Sequence
  Antimicrobial peptide sequence
GLVRILLRWLFRFGDNGNGNGGLARILLRLLFFRG

SEQ ID NO: 987 - protein, 35 aa, Artificial Sequence
  Antimicrobial peptide sequence
GLVRILLRWLFRFGDNGNGNGGLARILLRLLFRFG

SEQ ID NO: 988 - protein, 35 aa, Artificial Sequence
  Antimicrobial peptide sequence
GLVRILLRWLFRFGDNGNGNGGLVRILLRLLFRFG

SEQ ID NO: 989 - protein, 35 aa, Artificial Sequence
  Antimicrobial peptide sequence
GLVRILLRWLFRFGDNGNGNGSLVRILLRLLLRFG

SEQ ID NO: 990 - protein, 35 aa, Artificial Sequence
  Antimicrobial peptide sequence
GLVRILLRWLFRFGDNGNGNGGLVRILLRLLLRYG

SEQ ID NO: 991 - protein, 35 aa, Artificial Sequence
  Antimicrobial peptide sequence
GLVRILLRWLFRFGDNGNGNGGLAWILLRWLFFRG

SEQ ID NO: 992 - protein, 35 aa, Artificial Sequence
  Antimicrobial peptide sequence
GLVRILLRWLFRFGDNGNGNGGLVRILLRWLFFRG

SEQ ID NO: 993 - protein, 35 aa, Artificial Sequence
  Antimicrobial peptide sequence
GLVRILLRWLFRFGDNGNGNGGLLRILLRWLFFRG

SEQ ID NO: 994 - protein, 35 aa, Artificial Sequence
  Antimicrobial peptide sequence
GLVRILLRWLFRFGDNGNGNGGLPWILLRWLFRFG

SEQ ID NO: 995 - protein, 35 aa, Artificial Sequence
  Antimicrobial peptide sequence
GLVRILLRWLFRFGDNGNGNGGLLRILLRWLFRFG

SEQ ID NO: 996 - protein, 35 aa, Artificial Sequence
  Antimicrobial peptide sequence
GLVRILLRWLFRFGDNGNGNGGLPWILLRWLFRRG

SEQ ID NO: 997 - protein, 35 aa, Artificial Sequence
  Antimicrobial peptide sequence
GLVRILLRWLFRFGDGNGNGNGLPWILLRWLFFRG

SEQ ID NO: 998 - protein, 35 aa, Artificial Sequence
  Antimicrobial peptide sequence
GLVRILLRWLFRFGDGNGNGNGLARILLRWLFFRG

SEQ ID NO: 999 - protein, 35 aa, Artificial Sequence
  Antimicrobial peptide sequence
GLVRILLRWLFRFGDGNGNGNGLARILLRWLFRFG

SEQ ID NO: 1000 - protein, 35 aa, Artificial Sequence
  Antimicrobial peptide sequence
GLVRILLRWLFRFGDGNGNGNGLVRILLRWLFRFG

SEQ ID NO: 1001 - protein, 35 aa, Artificial Sequence
  Antimicrobial peptide sequence
GLVRILLRWLFRFGDGNGNGNGLARILLRLLFFRG

SEQ ID NO: 1002 - protein, 35 aa, Artificial Sequence
  Antimicrobial peptide sequence
GLVRILLRWLFRFGDGNGNGNGLARILLRLLFRFG

SEQ ID NO: 1003 - protein, 35 aa, Artificial Sequence
  Antimicrobial peptide sequence
GLVRILLRWLFRFGDGNGNGNGLVRILLRLLFRFG

SEQ ID NO: 1004 - protein, 35 aa, Artificial Sequence
  Antimicrobial peptide sequence
GLVRILLRWLFRFGDGNGNGNSLVRILLRLLLRFG

SEQ ID NO: 1005 - protein, 35 aa, Artificial Sequence
  Antimicrobial peptide sequence
GLVRILLRWLFRFGDGNGNGNGLVRILLRLLLRYG

SEQ ID NO: 1006 - protein, 35 aa, Artificial Sequence
  Antimicrobial peptide sequence
GLVRILLRWLFRFGDGNGNGNGLAWILLRWLFFRG

SEQ ID NO: 1007 - protein, 35 aa, Artificial Sequence
  Antimicrobial peptide sequence
GLVRILLRWLFRFGDGNGNGNGLVRILLRWLFFRG

SEQ ID NO: 1008 - protein, 35 aa, Artificial Sequence
  Antimicrobial peptide sequence
GLVRILLRWLFRFGDGNGNGNGLLRILLRWLFFRG

SEQ ID NO: 1009 - protein, 35 aa, Artificial Sequence
  Antimicrobial peptide sequence
GLVRILLRWLFRFGDGNGNGNGLPWILLRWLFRFG

SEQ ID NO: 1010 - protein, 35 aa, Artificial Sequence
  Antimicrobial peptide sequence
GLVRILLRWLFRFGDGNGNGNGLLRILLRWLFRFG

SEQ ID NO: 1011 - protein, 35 aa, Artificial Sequence
  Antimicrobial peptide sequence
GLVRILLRWLFRFGDGNGNGNGLPWILLRWLFRRG

SEQ ID NO: 1012 - protein, 35 aa, Artificial Sequence
  Antimicrobial peptide sequence
GLVRILLRWLFRFGDSGSGSGGLPWILLRWLFFRG

SEQ ID NO: 1013 - protein, 35 aa, Artificial Sequence
  Antimicrobial peptide sequence
GLVRILLRWLFRFGDSGSGSGGLARILLRWLFFRG

SEQ ID NO: 1014 - protein, 35 aa, Artificial Sequence
  Antimicrobial peptide sequence
GLVRILLRWLFRFGDSGSGSGGLARILLRWLFRFG

SEQ ID NO: 1015 - protein, 35 aa, Artificial Sequence
  Antimicrobial peptide sequence
GLVRILLRWLFRFGDSGSGSGGLVRILLRWLFRFG

SEQ ID NO: 1016 - protein, 35 aa, Artificial Sequence
  Antimicrobial peptide sequence
GLVRILLRWLFRFGDSGSGSGGLARILLRLLFFRG

SEQ ID NO: 1017 - protein, 35 aa, Artificial Sequence
  Antimicrobial peptide sequence
GLVRILLRWLFRFGDSGSGSGGLARILLRLLFRFG

SEQ ID NO: 1018 - protein, 35 aa, Artificial Sequence
  Antimicrobial peptide sequence
GLVRILLRWLFRFGDSGSGSGGLVRILLRLLFRFG

SEQ ID NO: 1019 - protein, 35 aa, Artificial Sequence
  Antimicrobial peptide sequence
GLVRILLRWLFRFGDSGSGSGSLVRILLRLLLRFG

SEQ ID NO: 1020 - protein, 35 aa, Artificial Sequence
  Antimicrobial peptide sequence
GLVRILLRWLFRFGDSGSGSGGLVRILLRLLLRYG

SEQ ID NO: 1021 - protein, 35 aa, Artificial Sequence
  Antimicrobial peptide sequence
GLVRILLRWLFRFGDSGSGSGGLAWILLRWLFFRG

SEQ ID NO: 1022 - protein, 35 aa, Artificial Sequence
  Antimicrobial peptide sequence
GLVRILLRWLFRFGDSGSGSGGLVRILLRWLFFRG

SEQ ID NO: 1023 - protein, 35 aa, Artificial Sequence
  Antimicrobial peptide sequence
GLVRILLRWLFRFGDSGSGSGGLLRILLRWLFFRG

SEQ ID NO: 1024 - protein, 35 aa, Artificial Sequence
  Antimicrobial peptide sequence
GLVRILLRWLFRFGDSGSGSGGLPWILLRWLFRFG

SEQ ID NO: 1025 - protein, 35 aa, Artificial Sequence
  Antimicrobial peptide sequence
GLVRILLRWLFRFGDSGSGSGGLLRILLRWLFRFG

SEQ ID NO: 1026 - protein, 35 aa, Artificial Sequence
  Antimicrobial peptide sequence
GLVRILLRWLFRFGDSGSGSGGLPWILLRWLFRRG

SEQ ID NO: 1027 - protein, 35 aa, Artificial Sequence
  Antimicrobial peptide sequence
GLVRILLRWLFRFGDGSGSGSGLPWILLRWLFFRG

SEQ ID NO: 1028 - protein, 35 aa, Artificial Sequence
  Antimicrobial peptide sequence
GLVRILLRWLFRFGDGSGSGSGLARILLRWLFFRG

SEQ ID NO: 1029 - protein, 35 aa, Artificial Sequence
  Antimicrobial peptide sequence
GLVRILLRWLFRFGDGSGSGSGLARILLRWLFRFG

SEQ ID NO: 1030 - protein, 35 aa, Artificial Sequence
  Antimicrobial peptide sequence
GLVRILLRWLFRFGDGSGSGSGLVRILLRWLFRFG

SEQ ID NO: 1031 - protein, 35 aa, Artificial Sequence
  Antimicrobial peptide sequence
GLVRILLRWLFRFGDGSGSGSGLARILLRLLFFRG

SEQ ID NO: 1032 - protein, 35 aa, Artificial Sequence
  Antimicrobial peptide sequence
GLVRILLRWLFRFGDGSGSGSGLARILLRLLFRFG

SEQ ID NO: 1033 - protein, 35 aa, Artificial Sequence
  Antimicrobial peptide sequence
GLVRILLRWLFRFGDGSGSGSGLVRILLRLLFRFG

SEQ ID NO: 1034 - protein, 35 aa, Artificial Sequence
  Antimicrobial peptide sequence
GLVRILLRWLFRFGDGSGSGSSLVRILLRLLLRFG

SEQ ID NO: 1035 - protein, 35 aa, Artificial Sequence
  Antimicrobial peptide sequence
GLVRILLRWLFRFGDGSGSGSGLVRILLRLLLRYG

SEQ ID NO: 1036 - protein, 35 aa, Artificial Sequence
  Antimicrobial peptide sequence
GLVRILLRWLFRFGDGSGSGSGLAWILLRWLFFRG

SEQ ID NO: 1037 - protein, 35 aa, Artificial Sequence
  Antimicrobial peptide sequence
GLVRILLRWLFRFGDGSGSGSGLVRILLRWLFFRG

SEQ ID NO: 1038 - protein, 35 aa, Artificial Sequence
  Antimicrobial peptide sequence
GLVRILLRWLFRFGDGSGSGSGLLRILLRWLFFRG

SEQ ID NO: 1039 - protein, 35 aa, Artificial Sequence
  Antimicrobial peptide sequence
GLVRILLRWLFRFGDGSGSGSGLPWILLRWLFRFG

SEQ ID NO: 1040 - protein, 35 aa, Artificial Sequence
  Antimicrobial peptide sequence
GLVRILLRWLFRFGDGSGSGSGLLRILLRWLFRFG

SEQ ID NO: 1041 - protein, 35 aa, Artificial Sequence
  Antimicrobial peptide sequence
GLVRILLRWLFRFGDGSGSGSGLPWILLRWLFRRG

SEQ ID NO: 1042 - protein, 35 aa, Artificial Sequence
  Antimicrobial peptide sequence
GLVRILLRWLFRFGDSNSNSNGLPWILLRWLFFRG

SEQ ID NO: 1043 - protein, 35 aa, Artificial Sequence
  Antimicrobial peptide sequence
GLVRILLRWLFRFGDSNSNSNGLARILLRWLFFRG

SEQ ID NO: 1044 - protein, 35 aa, Artificial Sequence
  Antimicrobial peptide sequence
GLVRILLRWLFRFGDSNSNSNGLARILLRWLFRFG

SEQ ID NO: 1045 - protein, 35 aa, Artificial Sequence
  Antimicrobial peptide sequence
GLVRILLRWLFRFGDSNSNSNGLVRILLRWLFRFG

SEQ ID NO: 1046 - protein, 35 aa, Artificial Sequence
  Antimicrobial peptide sequence
GLVRILLRWLFRFGDSNSNSNGLARILLRLLFFRG

SEQ ID NO: 1047 - protein, 35 aa, Artificial Sequence
  Antimicrobial peptide sequence
GLVRILLRWLFRFGDSNSNSNGLARILLRLLFRFG

SEQ ID NO: 1048 - protein, 35 aa, Artificial Sequence
  Antimicrobial peptide sequence
GLVRILLRWLFRFGDSNSNSNGLVRILLRLLFRFG

SEQ ID NO: 1049 - protein, 35 aa, Artificial Sequence
  Antimicrobial peptide sequence
GLVRILLRWLFRFGDSNSNSNSLVRILLRLLLRFG

SEQ ID NO: 1050 - protein, 35 aa, Artificial Sequence
  Antimicrobial peptide sequence
GLVRILLRWLFRFGDSNSNSNGLVRILLRLLLRYG

SEQ ID NO: 1051 - protein, 35 aa, Artificial Sequence
  Antimicrobial peptide sequence
GLVRILLRWLFRFGDSNSNSNGLAWILLRWLFFRG

SEQ ID NO: 1052 - protein, 35 aa, Artificial Sequence
  Antimicrobial peptide sequence
GLVRILLRWLFRFGDSNSNSNGLVRILLRWLFFRG

SEQ ID NO: 1053 - protein, 35 aa, Artificial Sequence
  Antimicrobial peptide sequence
GLVRILLRWLFRFGDSNSNSNGLLRILLRWLFFRG

SEQ ID NO: 1054 - protein, 35 aa, Artificial Sequence
  Antimicrobial peptide sequence
GLVRILLRWLFRFGDSNSNSNGLPWILLRWLFRFG

SEQ ID NO: 1055 - protein, 35 aa, Artificial Sequence
  Antimicrobial peptide sequence
GLVRILLRWLFRFGDSNSNSNGLLRILLRWLFRFG

SEQ ID NO: 1056 - protein, 35 aa, Artificial Sequence
  Antimicrobial peptide sequence
GLVRILLRWLFRFGDSNSNSNGLPWILLRWLFRRG

SEQ ID NO: 1057 - protein, 35 aa, Artificial Sequence
  Antimicrobial peptide sequence
GLVRILLRWLFRFGDNSNSNSGLPWILLRWLFFRG

SEQ ID NO: 1058 - protein, 35 aa, Artificial Sequence
  Antimicrobial peptide sequence
GLVRILLRWLFRFGDNSNSNSGLARILLRWLFFRG

SEQ ID NO: 1059 - protein, 35 aa, Artificial Sequence
  Antimicrobial peptide sequence
GLVRILLRWLFRFGDNSNSNSGLARILLRWLFRFG

SEQ ID NO: 1060 - protein, 35 aa, Artificial Sequence
  Antimicrobial peptide sequence
GLVRILLRWLFRFGDNSNSNSGLVRILLRWLFRFG

SEQ ID NO: 1061 - protein, 35 aa, Artificial Sequence
  Antimicrobial peptide sequence
GLVRILLRWLFRFGDNSNSNSGLARILLRLLFFRG

SEQ ID NO: 1062 - protein, 35 aa, Artificial Sequence
  Antimicrobial peptide sequence
GLVRILLRWLFRFGDNSNSNSGLARILLRLLFRFG

SEQ ID NO: 1063 - protein, 35 aa, Artificial Sequence
  Antimicrobial peptide sequence
GLVRILLRWLFRFGDNSNSNSGLVRILLRLLFRFG

SEQ ID NO: 1064 - protein, 35 aa, Artificial Sequence
  Antimicrobial peptide sequence
GLVRILLRWLFRFGDNSNSNSSLVRILLRLLLRFG

SEQ ID NO: 1065 - protein, 35 aa, Artificial Sequence
  Antimicrobial peptide sequence
GLVRILLRWLFRFGDNSNSNSGLVRILLRLLLRYG

SEQ ID NO: 1066 - protein, 35 aa, Artificial Sequence
  Antimicrobial peptide sequence
GLVRILLRWLFRFGDNSNSNSGLAWILLRWLFFRG

SEQ ID NO: 1067 - protein, 35 aa, Artificial Sequence
  Antimicrobial peptide sequence
GLVRILLRWLFRFGDNSNSNSGLVRILLRWLFFRG

SEQ ID NO: 1068 - protein, 35 aa, Artificial Sequence
  Antimicrobial peptide sequence
GLVRILLRWLFRFGDNSNSNSGLLRILLRWLFFRG

SEQ ID NO: 1069 - protein, 35 aa, Artificial Sequence
  Antimicrobial peptide sequence
GLVRILLRWLFRFGDNSNSNSGLPWILLRWLFRFG

SEQ ID NO: 1070 - protein, 35 aa, Artificial Sequence
  Antimicrobial peptide sequence
GLVRILLRWLFRFGDNSNSNSGLLRILLRWLFRFG

SEQ ID NO: 1071 - protein, 35 aa, Artificial Sequence
  Antimicrobial peptide sequence
GLVRILLRWLFRFGDNSNSNSGLPWILLRWLFRRG

SEQ ID NO: 1072 - protein, 35 aa, Artificial Sequence
  Antimicrobial peptide sequence
GLVRILLRWLFRFGDHGHGHGGLPWILLRWLFFRG

SEQ ID NO: 1073 - protein, 35 aa, Artificial Sequence
  Antimicrobial peptide sequence
GLVRILLRWLFRFGDHGHGHGGLARILLRWLFFRG

SEQ ID NO: 1074 - protein, 35 aa, Artificial Sequence
  Antimicrobial peptide sequence
GLVRILLRWLFRFGDHGHGHGGLARILLRWLFRFG

SEQ ID NO: 1075 - protein, 35 aa, Artificial Sequence
  Antimicrobial peptide sequence
GLVRILLRWLFRFGDHGHGHGGLVRILLRWLFRFG

SEQ ID NO: 1076 - protein, 35 aa, Artificial Sequence
  Antimicrobial peptide sequence
GLVRILLRWLFRFGDHGHGHGGLARILLRLLFFRG

SEQ ID NO: 1077 - protein, 35 aa, Artificial Sequence
  Antimicrobial peptide sequence
GLVRILLRWLFRFGDHGHGHGGLARILLRLLFRFG

SEQ ID NO: 1078 - protein, 35 aa, Artificial Sequence
  Antimicrobial peptide sequence
GLVRILLRWLFRFGDHGHGHGGLVRILLRLLFRFG

SEQ ID NO: 1079 - protein, 35 aa, Artificial Sequence
  Antimicrobial peptide sequence
GLVRILLRWLFRFGDHGHGHGSLVRILLRLLLRFG

SEQ ID NO: 1080 - protein, 35 aa, Artificial Sequence
  Antimicrobial peptide sequence
GLVRILLRWLFRFGDHGHGHGGLVRILLRLLLRYG

SEQ ID NO: 1081 - protein, 35 aa, Artificial Sequence
  Antimicrobial peptide sequence
GLVRILLRWLFRFGDHGHGHGGLAWILLRWLFFRG

SEQ ID NO: 1082 - protein, 35 aa, Artificial Sequence
  Antimicrobial peptide sequence
GLVRILLRWLFRFGDHGHGHGGLVRILLRWLFFRG

SEQ ID NO: 1083 - protein, 35 aa, Artificial Sequence
  Antimicrobial peptide sequence
GLVRILLRWLFRFGDHGHGHGGLLRILLRWLFFRG

SEQ ID NO: 1084 - protein, 35 aa, Artificial Sequence
  Antimicrobial peptide sequence
GLVRILLRWLFRFGDHGHGHGGLPWILLRWLFRFG

SEQ ID NO: 1085 - protein, 35 aa, Artificial Sequence
  Antimicrobial peptide sequence
GLVRILLRWLFRFGDHGHGHGGLLRILLRWLFRFG

SEQ ID NO: 1086 - protein, 35 aa, Artificial Sequence
  Antimicrobial peptide sequence
GLVRILLRWLFRFGDHGHGHGGLPWILLRWLFRRG

SEQ ID NO: 1087 - protein, 35 aa, Artificial Sequence
  Antimicrobial peptide sequence
GLVRILLRWLFRFGDGHGHGHGLPWILLRWLFFRG

SEQ ID NO: 1088 - protein, 35 aa, Artificial Sequence
  Antimicrobial peptide sequence
GLVRILLRWLFRFGDGHGHGHGLARILLRWLFFRG

SEQ ID NO: 1089 - protein, 35 aa, Artificial Sequence
  Antimicrobial peptide sequence
GLVRILLRWLFRFGDGHGHGHGLARILLRWLFRFG

SEQ ID NO: 1090 - protein, 35 aa, Artificial Sequence
  Antimicrobial peptide sequence
GLVRILLRWLFRFGDGHGHGHGLVRILLRWLFRFG

SEQ ID NO: 1091 - protein, 35 aa, Artificial Sequence
  Antimicrobial peptide sequence
GLVRILLRWLFRFGDGHGHGHGLARILLRLLFFRG

SEQ ID NO: 1092 - protein, 35 aa, Artificial Sequence
  Antimicrobial peptide sequence
GLVRILLRWLFRFGDGHGHGHGLARILLRLLFRFG

SEQ ID NO: 1093 - protein, 35 aa, Artificial Sequence
  Antimicrobial peptide sequence
GLVRILLRWLFRFGDGHGHGHGLVRILLRLLFRFG

SEQ ID NO: 1094 - protein, 35 aa, Artificial Sequence
  Antimicrobial peptide sequence
GLVRILLRWLFRFGDGHGHGHSLVRILLRLLLRFG

SEQ ID NO: 1095 - protein, 35 aa, Artificial Sequence
  Antimicrobial peptide sequence
GLVRILLRWLFRFGDGHGHGHGLVRILLRLLLRYG

SEQ ID NO: 1096 - protein, 35 aa, Artificial Sequence
  Antimicrobial peptide sequence
GLVRILLRWLFRFGDGHGHGHGLAWILLRWLFFRG

SEQ ID NO: 1097 - protein, 35 aa, Artificial Sequence
  Antimicrobial peptide sequence
GLVRILLRWLFRFGDGHGHGHGLVRILLRWLFFRG

SEQ ID NO: 1098 - protein, 35 aa, Artificial Sequence
  Antimicrobial peptide sequence
GLVRILLRWLFRFGDGHGHGHGLLRILLRWLFFRG

SEQ ID NO: 1099 - protein, 35 aa, Artificial Sequence
  Antimicrobial peptide sequence
GLVRILLRWLFRFGDGHGHGHGLPWILLRWLFRFG

SEQ ID NO: 1100 - protein, 35 aa, Artificial Sequence
  Antimicrobial peptide sequence
GLVRILLRWLFRFGDGHGHGHGLLRILLRWLFRFG

SEQ ID NO: 1101 - protein, 35 aa, Artificial Sequence
  Antimicrobial peptide sequence
GLVRILLRWLFRFGDGHGHGHGLPWILLRWLFRRG

SEQ ID NO: 1102 - protein, 35 aa, Artificial Sequence
  Antimicrobial peptide sequence
GLVRILLRWLFRFGDHNHNHNGLPWILLRWLFFRG

SEQ ID NO: 1103 - protein, 35 aa, Artificial Sequence
  Antimicrobial peptide sequence
GLVRILLRWLFRFGDHNHNHNGLARILLRWLFFRG

SEQ ID NO: 1104 - protein, 35 aa, Artificial Sequence
  Antimicrobial peptide sequence
GLVRILLRWLFRFGDHNHNHNGLARILLRWLFRFG

SEQ ID NO: 1105 - protein, 35 aa, Artificial Sequence
  Antimicrobial peptide sequence
GLVRILLRWLFRFGDHNHNHNGLVRILLRWLFRFG

SEQ ID NO: 1106 - protein, 35 aa, Artificial Sequence
  Antimicrobial peptide sequence
GLVRILLRWLFRFGDHNHNHNGLARILLRLLFFRG

SEQ ID NO: 1107 - protein, 35 aa, Artificial Sequence
  Antimicrobial peptide sequence
GLVRILLRWLFRFGDHNHNHNGLARILLRLLFRFG

SEQ ID NO: 1108 - protein, 35 aa, Artificial Sequence
  Antimicrobial peptide sequence
GLVRILLRWLFRFGDHNHNHNGLVRILLRLLFRFG

SEQ ID NO: 1109 - protein, 35 aa, Artificial Sequence
  Antimicrobial peptide sequence
GLVRILLRWLFRFGDHNHNHNSLVRILLRLLLRFG

SEQ ID NO: 1110 - protein, 35 aa, Artificial Sequence
  Antimicrobial peptide sequence
GLVRILLRWLFRFGDHNHNHNGLVRILLRLLLRYG

SEQ ID NO: 1111 - protein, 35 aa, Artificial Sequence
  Antimicrobial peptide sequence
GLVRILLRWLFRFGDHNHNHNGLAWILLRWLFFRG

SEQ ID NO: 1112 - protein, 35 aa, Artificial Sequence
  Antimicrobial peptide sequence
GLVRILLRWLFRFGDHNHNHNGLVRILLRWLFFRG

SEQ ID NO: 1113 - protein, 35 aa, Artificial Sequence
  Antimicrobial peptide sequence
GLVRILLRWLFRFGDHNHNHNGLLRILLRWLFFRG

SEQ ID NO: 1114 - protein, 35 aa, Artificial Sequence
  Antimicrobial peptide sequence
GLVRILLRWLFRFGDHNHNHNGLPWILLRWLFRFG

SEQ ID NO: 1115 - protein, 35 aa, Artificial Sequence
  Antimicrobial peptide sequence
GLVRILLRWLFRFGDHNHNHNGLLRILLRWLFRFG

SEQ ID NO: 1116 - protein, 35 aa, Artificial Sequence
  Antimicrobial peptide sequence
GLVRILLRWLFRFGDHNHNHNGLPWILLRWLFRRG

SEQ ID NO: 1117 - protein, 35 aa, Artificial Sequence
  Antimicrobial peptide sequence
GLVRILLRWLFRFGDNHNHNHGLPWILLRWLFFRG

SEQ ID NO: 1118 - protein, 35 aa, Artificial Sequence
  Antimicrobial peptide sequence
GLVRILLRWLFRFGDNHNHNHGLARILLRWLFFRG

SEQ ID NO: 1119 - protein, 35 aa, Artificial Sequence
  Antimicrobial peptide sequence
GLVRILLRWLFRFGDNHNHNHGLARILLRWLFRFG

SEQ ID NO: 1120 - protein, 35 aa, Artificial Sequence
  Antimicrobial peptide sequence
GLVRILLRWLFRFGDNHNHNHGLVRILLRWLFRFG

SEQ ID NO: 1121 - protein, 35 aa, Artificial Sequence
  Antimicrobial peptide sequence
GLVRILLRWLFRFGDNHNHNHGLARILLRLLFFRG

SEQ ID NO: 1122 - protein, 35 aa, Artificial Sequence
  Antimicrobial peptide sequence
GLVRILLRWLFRFGDNHNHNHGLARILLRLLFRFG

SEQ ID NO: 1123 - protein, 35 aa, Artificial Sequence
  Antimicrobial peptide sequence
GLVRILLRWLFRFGDNHNHNHGLVRILLRLLFRFG

SEQ ID NO: 1124 - protein, 35 aa, Artificial Sequence
  Antimicrobial peptide sequence
GLVRILLRWLFRFGDNHNHNHSLVRILLRLLLRFG

SEQ ID NO: 1125 - protein, 35 aa, Artificial Sequence
  Antimicrobial peptide sequence
GLVRILLRWLFRFGDNHNHNHGLVRILLRLLLRYG

SEQ ID NO: 1126 - protein, 35 aa, Artificial Sequence
  Antimicrobial peptide sequence
GLVRILLRWLFRFGDNHNHNHGLAWILLRWLFFRG

SEQ ID NO: 1127 - protein, 35 aa, Artificial Sequence
  Antimicrobial peptide sequence
GLVRILLRWLFRFGDNHNHNHGLVRILLRWLFFRG

SEQ ID NO: 1128 - protein, 35 aa, Artificial Sequence
  Antimicrobial peptide sequence
GLVRILLRWLFRFGDNHNHNHGLLRILLRWLFFRG

SEQ ID NO: 1129 - protein, 35 aa, Artificial Sequence
  Antimicrobial peptide sequence
GLVRILLRWLFRFGDNHNHNHGLPWILLRWLFRFG

SEQ ID NO: 1130 - protein, 35 aa, Artificial Sequence
  Antimicrobial peptide sequence
GLVRILLRWLFRFGDNHNHNHGLLRILLRWLFRFG

SEQ ID NO: 1131 - protein, 35 aa, Artificial Sequence
  Antimicrobial peptide sequence
GLVRILLRWLFRFGDNHNHNHGLPWILLRWLFRRG

SEQ ID NO: 1132 - protein, 33 aa, Artificial Sequence
  Antimicrobial peptide sequence
GLARILLRLLFFRGDGGGGGLPWILLRWLFFRG

SEQ ID NO: 1133 - protein, 33 aa, Artificial Sequence
  Antimicrobial peptide sequence
GLARILLRLLFFRGDGGGGGLARILLRWLFFRG

SEQ ID NO: 1134 - protein, 33 aa, Artificial Sequence
  Antimicrobial peptide sequence
GLARILLRLLFFRGDGGGGGLARILLRWLFRFG

SEQ ID NO: 1135 - protein, 33 aa, Artificial Sequence
  Antimicrobial peptide sequence
GLARILLRLLFFRGDGGGGGLVRILLRWLFRFG

SEQ ID NO: 1136 - protein, 33 aa, Artificial Sequence
  Antimicrobial peptide sequence
GLARILLRLLFFRGDGGGGGLARILLRLLFFRG

SEQ ID NO: 1137 - protein, 33 aa, Artificial Sequence
  Antimicrobial peptide sequence
GLARILLRLLFFRGDGGGGGLARILLRLLFRFG

SEQ ID NO: 1138 - protein, 33 aa, Artificial Sequence
  Antimicrobial peptide sequence
GLARILLRLLFFRGDGGGGGLVRILLRLLFRFG

SEQ ID NO: 1139 - protein, 33 aa, Artificial Sequence
  Antimicrobial peptide sequence
GLARILLRLLFFRGDGGGGSLVRILLRLLLRFG

SEQ ID NO: 1140 - protein, 33 aa, Artificial Sequence
  Antimicrobial peptide sequence
GLARILLRLLFFRGDGGGGGLVRILLRLLLRYG

SEQ ID NO: 1141 - protein, 33 aa, Artificial Sequence
  Antimicrobial peptide sequence
GLARILLRLLFFRGDGGGGGLAWILLRWLFFRG

SEQ ID NO: 1142 - protein, 33 aa, Artificial Sequence
  Antimicrobial peptide sequence
GLARILLRLLFFRGDGGGGGLVRILLRWLFFRG

SEQ ID NO: 1143 - protein, 33 aa, Artificial Sequence
  Antimicrobial peptide sequence
GLARILLRLLFFRGDGGGGGLLRILLRWLFFRG

SEQ ID NO: 1144 - protein, 33 aa, Artificial Sequence
  Antimicrobial peptide sequence
GLARILLRLLFFRGDGGGGGLPWILLRWLFRFG

SEQ ID NO: 1145 - protein, 33 aa, Artificial Sequence
  Antimicrobial peptide sequence
GLARILLRLLFFRGDGGGGGLLRILLRWLFRFG

SEQ ID NO: 1146 - protein, 33 aa, Artificial Sequence
  Antimicrobial peptide sequence
GLARILLRLLFFRGDGGGGGLPWILLRWLFRRG

SEQ ID NO: 1147 - protein, 34 aa, Artificial Sequence
  Antimicrobial peptide sequence
GLARILLRLLFFRGDGGGGGGLPWILLRWLFFRG

SEQ ID NO: 1148 - protein, 34 aa, Artificial Sequence
  Antimicrobial peptide sequence
GLARILLRLLFFRGDGGGGGGLARILLRWLFFRG

SEQ ID NO: 1149 - protein, 34 aa, Artificial Sequence
  Antimicrobial peptide sequence
GLARILLRLLFFRGDGGGGGGLARILLRWLFRFG

SEQ ID NO: 1150 - protein, 34 aa, Artificial Sequence
  Antimicrobial peptide sequence
GLARILLRLLFFRGDGGGGGGLVRILLRWLFRFG

SEQ ID NO: 1151 - protein, 34 aa, Artificial Sequence; identical to SEQ ID NO: 50
  Antimicrobial peptide sequence

SEQ ID NO: 1152 - protein, 34 aa, Artificial Sequence
  Antimicrobial peptide sequence
GLARILLRLLFFRGDGGGGGGLARILLRLLFRFG

SEQ ID NO: 1153 - protein, 34 aa, Artificial Sequence
  Antimicrobial peptide sequence
GLARILLRLLFFRGDGGGGGGLVRILLRLLFRFG

SEQ ID NO: 1154 - protein, 34 aa, Artificial Sequence
  Antimicrobial peptide sequence
GLARILLRLLFFRGDGGGGGSLVRILLRLLLRFG

SEQ ID NO: 1155 - protein, 34 aa, Artificial Sequence
  Antimicrobial peptide sequence
GLARILLRLLFFRGDGGGGGGLVRILLRLLLRYG

SEQ ID NO: 1156 - protein, 34 aa, Artificial Sequence
  Antimicrobial peptide sequence
GLARILLRLLFFRGDGGGGGGLAWILLRWLFFRG

SEQ ID NO: 1157 - protein, 34 aa, Artificial Sequence
  Antimicrobial peptide sequence
GLARILLRLLFFRGDGGGGGGLVRILLRWLFFRG

SEQ ID NO: 1158 - protein, 34 aa, Artificial Sequence
  Antimicrobial peptide sequence
GLARILLRLLFFRGDGGGGGGLLRILLRWLFFRG

SEQ ID NO: 1159 - protein, 34 aa, Artificial Sequence
  Antimicrobial peptide sequence
GLARILLRLLFFRGDGGGGGGLPWILLRWLFRFG

SEQ ID NO: 1160 - protein, 34 aa, Artificial Sequence
  Antimicrobial peptide sequence
GLARILLRLLFFRGDGGGGGGLLRILLRWLFRFG

SEQ ID NO: 1161 - protein, 34 aa, Artificial Sequence
  Antimicrobial peptide sequence
GLARILLRLLFFRGDGGGGGGLPWILLRWLFRRG

SEQ ID NO: 1162 - protein, 35 aa, Artificial Sequence
  Antimicrobial peptide sequence
GLARILLRLLFFRGDGGGGGGGLPWILLRWLFFRG

SEQ ID NO: 1163 - protein, 35 aa, Artificial Sequence
  Antimicrobial peptide sequence
GLARILLRLLFFRGDGGGGGGGLARILLRWLFFRG

SEQ ID NO: 1164 - protein, 35 aa, Artificial Sequence
  Antimicrobial peptide sequence
GLARILLRLLFFRGDGGGGGGGLARILLRWLFRFG

SEQ ID NO: 1165 - protein, 35 aa, Artificial Sequence
  Antimicrobial peptide sequence
GLARILLRLLFFRGDGGGGGGGLVRILLRWLFRFG

SEQ ID NO: 1166 - protein, 35 aa, Artificial Sequence; identical to SEQ ID NO: 44
  Antimicrobial peptide sequence

SEQ ID NO: 1167 - protein, 35 aa, Artificial Sequence
  Antimicrobial peptide sequence
GLARILLRLLFFRGDGGGGGGGLARILLRLLFRFG

SEQ ID NO: 1168 - protein, 35 aa, Artificial Sequence
  Antimicrobial peptide sequence
GLARILLRLLFFRGDGGGGGGGLVRILLRLLFRFG

SEQ ID NO: 1169 - protein, 35 aa, Artificial Sequence
  Antimicrobial peptide sequence
GLARILLRLLFFRGDGGGGGGSLVRILLRLLLRFG

SEQ ID NO: 1170 - protein, 35 aa, Artificial Sequence
  Antimicrobial peptide sequence
GLARILLRLLFFRGDGGGGGGGLVRILLRLLLRYG

SEQ ID NO: 1171 - protein, 35 aa, Artificial Sequence
  Antimicrobial peptide sequence
GLARILLRLLFFRGDGGGGGGGLAWILLRWLFFRG

SEQ ID NO: 1172 - protein, 35 aa, Artificial Sequence
  Antimicrobial peptide sequence
GLARILLRLLFFRGDGGGGGGGLVRILLRWLFFRG

SEQ ID NO: 1173 - protein, 35 aa, Artificial Sequence
  Antimicrobial peptide sequence
GLARILLRLLFFRGDGGGGGGGLLRILLRWLFFRG

SEQ ID NO: 1174 - protein, 35 aa, Artificial Sequence
  Antimicrobial peptide sequence
GLARILLRLLFFRGDGGGGGGGLPWILLRWLFRFG

SEQ ID NO: 1175 - protein, 35 aa, Artificial Sequence
  Antimicrobial peptide sequence
GLARILLRLLFFRGDGGGGGGGLLRILLRWLFRFG

SEQ ID NO: 1176 - protein, 35 aa, Artificial Sequence
  Antimicrobial peptide sequence
GLARILLRLLFFRGDGGGGGGGLPWILLRWLFRRG

SEQ ID NO: 1177 - protein, 36 aa, Artificial Sequence
  Antimicrobial peptide sequence
GLARILLRLLFFRGDGGGGGGGGLPWILLRWLFFRG

SEQ ID NO: 1178 - protein, 36 aa, Artificial Sequence
  Antimicrobial peptide sequence
GLARILLRLLFFRGDGGGGGGGGLARILLRWLFFRG

SEQ ID NO: 1179 - protein, 36 aa, Artificial Sequence
  Antimicrobial peptide sequence
GLARILLRLLFFRGDGGGGGGGGLARILLRWLFRFG

SEQ ID NO: 1180 - protein, 36 aa, Artificial Sequence
  Antimicrobial peptide sequence
GLARILLRLLFFRGDGGGGGGGGLVRILLRWLFRFG

SEQ ID NO: 1181 - protein, 36 aa, Artificial Sequence
  Antimicrobial peptide sequence
GLARILLRLLFFRGDGGGGGGGGLARILLRLLFFRG

SEQ ID NO: 1182 - protein, 36 aa, Artificial Sequence
  Antimicrobial peptide sequence
GLARILLRLLFFRGDGGGGGGGGLARILLRLLFRFG

SEQ ID NO: 1183 - protein, 36 aa, Artificial Sequence
  Antimicrobial peptide sequence
GLARILLRLLFFRGDGGGGGGGGLVRILLRLLFRFG

SEQ ID NO: 1184 - protein, 36 aa, Artificial Sequence
  Antimicrobial peptide sequence
GLARILLRLLFFRGDGGGGGGGSLVRILLRLLLRFG

SEQ ID NO: 1185 - protein, 36 aa, Artificial Sequence
  Antimicrobial peptide sequence
GLARILLRLLFFRGDGGGGGGGGLVRILLRLLLRYG

SEQ ID NO: 1186 - protein, 36 aa, Artificial Sequence
  Antimicrobial peptide sequence
GLARILLRLLFFRGDGGGGGGGGLAWILLRWLFFRG

SEQ ID NO: 1187 - protein, 36 aa, Artificial Sequence
  Antimicrobial peptide sequence
GLARILLRLLFFRGDGGGGGGGGLVRILLRWLFFRG

SEQ ID NO: 1188 - protein, 36 aa, Artificial Sequence
  Antimicrobial peptide sequence
GLARILLRLLFFRGDGGGGGGGGLLRILLRWLFFRG

SEQ ID NO: 1189 - protein, 36 aa, Artificial Sequence
  Antimicrobial peptide sequence
GLARILLRLLFFRGDGGGGGGGGLPWILLRWLFRFG

SEQ ID NO: 1190 - protein, 36 aa, Artificial Sequence
  Antimicrobial peptide sequence
GLARILLRLLFFRGDGGGGGGGGLLRILLRWLFRFG

SEQ ID NO: 1191 - protein, 36 aa, Artificial Sequence
  Antimicrobial peptide sequence
GLARILLRLLFFRGDGGGGGGGGLPWILLRWLFRRG

SEQ ID NO: 1192 - protein, 33 aa, Artificial Sequence
  Antimicrobial peptide sequence
GLARILLRLLFFRGDNNNNGLPWILLRWLFFRG

SEQ ID NO: 1193 - protein, 33 aa, Artificial Sequence
  Antimicrobial peptide sequence
GLARILLRLLFFRGDNNNNGLARILLRWLFFRG

SEQ ID NO: 1194 - protein, 33 aa, Artificial Sequence
  Antimicrobial peptide sequence
GLARILLRLLFFRGDNNNNGLARILLRWLFRFG

SEQ ID NO: 1195 - protein, 33 aa, Artificial Sequence
  Antimicrobial peptide sequence
GLARILLRLLFFRGDNNNNGLVRILLRWLFRFG

SEQ ID NO: 1196 - protein, 33 aa, Artificial Sequence
  Antimicrobial peptide sequence
GLARILLRLLFFRGDNNNNGLARILLRLLFFRG

SEQ ID NO: 1197 - protein, 33 aa, Artificial Sequence
  Antimicrobial peptide sequence
GLARILLRLLFFRGDNNNNGLARILLRLLFRFG

SEQ ID NO: 1198 - protein, 33 aa, Artificial Sequence
  Antimicrobial peptide sequence
GLARILLRLLFFRGDNNNNGLVRILLRLLFRFG

SEQ ID NO: 1199 - protein, 33 aa, Artificial Sequence
  Antimicrobial peptide sequence
GLARILLRLLFFRGDNNNNSLVRILLRLLLRFG

SEQ ID NO: 1200 - protein, 33 aa, Artificial Sequence
  Antimicrobial peptide sequence
GLARILLRLLFFRGDNNNNGLVRILLRLLLRYG

SEQ ID NO: 1201 - protein, 33 aa, Artificial Sequence
  Antimicrobial peptide sequence
GLARILLRLLFFRGDNNNNGLAWILLRWLFFRG

SEQ ID NO: 1202 - protein, 33 aa, Artificial Sequence
  Antimicrobial peptide sequence
GLARILLRLLFFRGDNNNNGLVRILLRWLFFRG

SEQ ID NO: 1203 - protein, 33 aa, Artificial Sequence
  Antimicrobial peptide sequence
GLARILLRLLFFRGDNNNNGLLRILLRWLFFRG

SEQ ID NO: 1204 - protein, 33 aa, Artificial Sequence
  Antimicrobial peptide sequence
GLARILLRLLFFRGDNNNNGLPWILLRWLFRFG

SEQ ID NO: 1205 - protein, 33 aa, Artificial Sequence
  Antimicrobial peptide sequence
GLARILLRLLFFRGDNNNNGLLRILLRWLFRFG

SEQ ID NO: 1206 - protein, 33 aa, Artificial Sequence
  Antimicrobial peptide sequence
GLARILLRLLFFRGDNNNNGLPWILLRWLFRRG

SEQ ID NO: 1207 - protein, 34 aa, Artificial Sequence
  Antimicrobial peptide sequence
GLARILLRLLFFRGDNNNNNGLPWILLRWLFFRG

SEQ ID NO: 1208 - protein, 34 aa, Artificial Sequence
  Antimicrobial peptide sequence
GLARILLRLLFFRGDNNNNNGLARILLRWLFFRG

SEQ ID NO: 1209 - protein, 34 aa, Artificial Sequence
  Antimicrobial peptide sequence
GLARILLRLLFFRGDNNNNNGLARILLRWLFRFG

SEQ ID NO: 1210 - protein, 34 aa, Artificial Sequence
  Antimicrobial peptide sequence
GLARILLRLLFFRGDNNNNNGLVRILLRWLFRFG

SEQ ID NO: 1211 - protein, 34 aa, Artificial Sequence; identical to SEQ ID NO: 51
  Antimicrobial peptide sequence

SEQ ID NO: 1212 - protein, 34 aa, Artificial Sequence
  Antimicrobial peptide sequence
GLARILLRLLFFRGDNNNNNGLARILLRLLFRFG

SEQ ID NO: 1213 - protein, 34 aa, Artificial Sequence
  Antimicrobial peptide sequence
GLARILLRLLFFRGDNNNNNGLVRILLRLLFRFG

SEQ ID NO: 1214 - protein, 34 aa, Artificial Sequence
  Antimicrobial peptide sequence
GLARILLRLLFFRGDNNNNNSLVRILLRLLLRFG

SEQ ID NO: 1215 - protein, 34 aa, Artificial Sequence
  Antimicrobial peptide sequence
GLARILLRLLFFRGDNNNNNGLVRILLRLLLRYG

SEQ ID NO: 1216 - protein, 34 aa, Artificial Sequence
  Antimicrobial peptide sequence
GLARILLRLLFFRGDNNNNNGLAWILLRWLFFRG

SEQ ID NO: 1217 - protein, 34 aa, Artificial Sequence
  Antimicrobial peptide sequence
GLARILLRLLFFRGDNNNNNGLVRILLRWLFFRG

SEQ ID NO: 1218 - protein, 34 aa, Artificial Sequence
  Antimicrobial peptide sequence
GLARILLRLLFFRGDNNNNNGLLRILLRWLFFRG

SEQ ID NO: 1219 - protein, 34 aa, Artificial Sequence
  Antimicrobial peptide sequence
GLARILLRLLFFRGDNNNNNGLPWILLRWLFRFG

SEQ ID NO: 1220 - protein, 34 aa, Artificial Sequence
  Antimicrobial peptide sequence
GLARILLRLLFFRGDNNNNNGLLRILLRWLFRFG

SEQ ID NO: 1221 - protein, 34 aa, Artificial Sequence
  Antimicrobial peptide sequence
GLARILLRLLFFRGDNNNNNGLPWILLRWLFRRG

SEQ ID NO: 1222 - protein, 35 aa, Artificial Sequence
  Antimicrobial peptide sequence
GLARILLRLLFFRGDNNNNNNGLPWILLRWLFFRG

SEQ ID NO: 1223 - protein, 35 aa, Artificial Sequence
  Antimicrobial peptide sequence
GLARILLRLLFFRGDNNNNNNGLARILLRWLFFRG

SEQ ID NO: 1224 - protein, 35 aa, Artificial Sequence
  Antimicrobial peptide sequence
GLARILLRLLFFRGDNNNNNNGLARILLRWLFRFG

SEQ ID NO: 1225 - protein, 35 aa, Artificial Sequence
  Antimicrobial peptide sequence
GLARILLRLLFFRGDNNNNNNGLVRILLRWLFRFG

SEQ ID NO: 1226 - protein, 35 aa, Artificial Sequence; identical to SEQ ID NO: 45
  Antimicrobial peptide sequence

SEQ ID NO: 1227 - protein, 35 aa, Artificial Sequence
  Antimicrobial peptide sequence
GLARILLRLLFFRGDNNNNNNGLARILLRLLFRFG

SEQ ID NO: 1228 - protein, 35 aa, Artificial Sequence
  Antimicrobial peptide sequence
GLARILLRLLFFRGDNNNNNNGLVRILLRLLFRFG

SEQ ID NO: 1229 - protein, 35 aa, Artificial Sequence
  Antimicrobial peptide sequence
GLARILLRLLFFRGDNNNNNNSLVRILLRLLLRFG

SEQ ID NO: 1230 - protein, 35 aa, Artificial Sequence
  Antimicrobial peptide sequence
GLARILLRLLFFRGDNNNNNNGLVRILLRLLLRYG

SEQ ID NO: 1231 - protein, 35 aa, Artificial Sequence
  Antimicrobial peptide sequence
GLARILLRLLFFRGDNNNNNNGLAWILLRWLFFRG

SEQ ID NO: 1232 - protein, 35 aa, Artificial Sequence
  Antimicrobial peptide sequence
GLARILLRLLFFRGDNNNNNNGLVRILLRWLFFRG

SEQ ID NO: 1233 - protein, 35 aa, Artificial Sequence
  Antimicrobial peptide sequence
GLARILLRLLFFRGDNNNNNNGLLRILLRWLFFRG

SEQ ID NO: 1234 - protein, 35 aa, Artificial Sequence
  Antimicrobial peptide sequence
GLARILLRLLFFRGDNNNNNNGLPWILLRWLFRFG

SEQ ID NO: 1235 - protein, 35 aa, Artificial Sequence
  Antimicrobial peptide sequence
GLARILLRLLFFRGDNNNNNNGLLRILLRWLFRFG

SEQ ID NO: 1236 - protein, 35 aa, Artificial Sequence
  Antimicrobial peptide sequence
GLARILLRLLFFRGDNNNNNNGLPWILLRWLFRRG

SEQ ID NO: 1237 - protein, 36 aa, Artificial Sequence
  Antimicrobial peptide sequence
GLARILLRLLFFRGDNNNNNNNGLPWILLRWLFFRG

SEQ ID NO: 1238 - protein, 36 aa, Artificial Sequence
  Antimicrobial peptide sequence
GLARILLRLLFFRGDNNNNNNNGLARILLRWLFFRG

SEQ ID NO: 1239 - protein, 36 aa, Artificial Sequence
  Antimicrobial peptide sequence
GLARILLRLLFFRGDNNNNNNNGLARILLRWLFRFG

SEQ ID NO: 1240 - protein, 36 aa, Artificial Sequence
  Antimicrobial peptide sequence
GLARILLRLLFFRGDNNNNNNNGLVRILLRWLFRFG

SEQ ID NO: 1241 - protein, 36 aa, Artificial Sequence
  Antimicrobial peptide sequence
GLARILLRLLFFRGDNNNNNNNGLARILLRLLFFRG

SEQ ID NO: 1242 - protein, 36 aa, Artificial Sequence
  Antimicrobial peptide sequence
GLARILLRLLFFRGDNNNNNNNGLARILLRLLFRFG

SEQ ID NO: 1243 - protein, 36 aa, Artificial Sequence
  Antimicrobial peptide sequence
GLARILLRLLFFRGDNNNNNNNGLVRILLRLLFRFG

SEQ ID NO: 1244 - protein, 36 aa, Artificial Sequence
  Antimicrobial peptide sequence
GLARILLRLLFFRGDNNNNNNNSLVRILLRLLLRFG

SEQ ID NO: 1245 - protein, 36 aa, Artificial Sequence
  Antimicrobial peptide sequence
GLARILLRLLFFRGDNNNNNNNGLVRILLRLLLRYG

SEQ ID NO: 1246 - protein, 36 aa, Artificial Sequence
  Antimicrobial peptide sequence
GLARILLRLLFFRGDNNNNNNNGLAWILLRWLFFRG

SEQ ID NO: 1247 - protein, 36 aa, Artificial Sequence
  Antimicrobial peptide sequence
GLARILLRLLFFRGDNNNNNNNGLVRILLRWLFFRG

SEQ ID NO: 1248 - protein, 36 aa, Artificial Sequence
  Antimicrobial peptide sequence
GLARILLRLLFFRGDNNNNNNNGLLRILLRWLFFRG

SEQ ID NO: 1249 - protein, 36 aa, Artificial Sequence
  Antimicrobial peptide sequence
GLARILLRLLFFRGDNNNNNNNGLPWILLRWLFRFG

SEQ ID NO: 1250 - protein, 36 aa, Artificial Sequence
  Antimicrobial peptide sequence
GLARILLRLLFFRGDNNNNNNNGLLRILLRWLFRFG

SEQ ID NO: 1251 - protein, 36 aa, Artificial Sequence
  Antimicrobial peptide sequence
GLARILLRLLFFRGDNNNNNNNGLPWILLRWLFRRG

SEQ ID NO: 1252 - protein, 35 aa, Artificial Sequence
  Antimicrobial peptide sequence
GLARILLRLLFFRGDNGNGNGGLPWILLRWLFFRG

SEQ ID NO: 1253 - protein, 35 aa, Artificial Sequence
  Antimicrobial peptide sequence
GLARILLRLLFFRGDNGNGNGGLARILLRWLFFRG

SEQ ID NO: 1254 - protein, 35 aa, Artificial Sequence
  Antimicrobial peptide sequence
GLARILLRLLFFRGDNGNGNGGLARILLRWLFRFG

SEQ ID NO: 1255 - protein, 35 aa, Artificial Sequence
  Antimicrobial peptide sequence
GLARILLRLLFFRGDNGNGNGGLVRILLRWLFRFG

SEQ ID NO: 1256 - protein, 35 aa, Artificial Sequence
  Antimicrobial peptide sequence
GLARILLRLLFFRGDNGNGNGGLARILLRLLFFRG

SEQ ID NO: 1257 - protein, 35 aa, Artificial Sequence
  Antimicrobial peptide sequence
GLARILLRLLFFRGDNGNGNGGLARILLRLLFRFG

SEQ ID NO: 1258 - protein, 35 aa, Artificial Sequence
  Antimicrobial peptide sequence
GLARILLRLLFFRGDNGNGNGGLVRILLRLLFRFG

SEQ ID NO: 1259 - protein, 35 aa, Artificial Sequence
  Antimicrobial peptide sequence
GLARILLRLLFFRGDNGNGNGSLVRILLRLLLRFG

SEQ ID NO: 1260 - protein, 35 aa, Artificial Sequence
  Antimicrobial peptide sequence
GLARILLRLLFFRGDNGNGNGGLVRILLRLLLRYG

SEQ ID NO: 1261 - protein, 35 aa, Artificial Sequence
  Antimicrobial peptide sequence
GLARILLRLLFFRGDNGNGNGGLAWILLRWLFFRG

SEQ ID NO: 1262 - protein, 35 aa, Artificial Sequence
  Antimicrobial peptide sequence
GLARILLRLLFFRGDNGNGNGGLVRILLRWLFFRG

SEQ ID NO: 1263 - protein, 35 aa, Artificial Sequence
  Antimicrobial peptide sequence
GLARILLRLLFFRGDNGNGNGGLLRILLRWLFFRG

SEQ ID NO: 1264 - protein, 35 aa, Artificial Sequence
  Antimicrobial peptide sequence
GLARILLRLLFFRGDNGNGNGGLPWILLRWLFRFG

SEQ ID NO: 1265 - protein, 35 aa, Artificial Sequence
  Antimicrobial peptide sequence
GLARILLRLLFFRGDNGNGNGGLLRILLRWLFRFG

SEQ ID NO: 1266 - protein, 35 aa, Artificial Sequence
  Antimicrobial peptide sequence
GLARILLRLLFFRGDNGNGNGGLPWILLRWLFRRG

SEQ ID NO: 1267 - protein, 35 aa, Artificial Sequence
  Antimicrobial peptide sequence
GLARILLRLLFFRGDGNGNGNGLPWILLRWLFFRG

SEQ ID NO: 1268 - protein, 35 aa, Artificial Sequence
  Antimicrobial peptide sequence
GLARILLRLLFFRGDGNGNGNGLARILLRWLFFRG

SEQ ID NO: 1269 - protein, 35 aa, Artificial Sequence
  Antimicrobial peptide sequence
GLARILLRLLFFRGDGNGNGNGLARILLRWLFRFG

SEQ ID NO: 1270 - protein, 35 aa, Artificial Sequence
  Antimicrobial peptide sequence
GLARILLRLLFFRGDGNGNGNGLVRILLRWLFRFG

SEQ ID NO: 1271 - protein, 35 aa, Artificial Sequence
  Antimicrobial peptide sequence
GLARILLRLLFFRGDGNGNGNGLARILLRLLFFRG

SEQ ID NO: 1272 - protein, 35 aa, Artificial Sequence
  Antimicrobial peptide sequence
GLARILLRLLFFRGDGNGNGNGLARILLRLLFRFG

SEQ ID NO: 1273 - protein, 35 aa, Artificial Sequence
  Antimicrobial peptide sequence
GLARILLRLLFFRGDGNGNGNGLVRILLRLLFRFG

SEQ ID NO: 1274 - protein, 35 aa, Artificial Sequence
  Antimicrobial peptide sequence
GLARILLRLLFFRGDGNGNGNSLVRILLRLLLRFG

SEQ ID NO: 1275 - protein, 35 aa, Artificial Sequence
  Antimicrobial peptide sequence
GLARILLRLLFFRGDGNGNGNGLVRILLRLLLRYG

SEQ ID NO: 1276 - protein, 35 aa, Artificial Sequence
  Antimicrobial peptide sequence
GLARILLRLLFFRGDGNGNGNGLAWILLRWLFFRG

SEQ ID NO: 1277 - protein, 35 aa, Artificial Sequence
  Antimicrobial peptide sequence
GLARILLRLLFFRGDGNGNGNGLVRILLRWLFFRG

SEQ ID NO: 1278 - protein, 35 aa, Artificial Sequence
  Antimicrobial peptide sequence
GLARILLRLLFFRGDGNGNGNGLLRILLRWLFFRG

SEQ ID NO: 1279 - protein, 35 aa, Artificial Sequence
  Antimicrobial peptide sequence
GLARILLRLLFFRGDGNGNGNGLPWILLRWLFRFG

SEQ ID NO: 1280 - protein, 35 aa, Artificial Sequence
  Antimicrobial peptide sequence
GLARILLRLLFFRGDGNGNGNGLLRILLRWLFRFG

SEQ ID NO: 1281 - protein, 35 aa, Artificial Sequence
  Antimicrobial peptide sequence
GLARILLRLLFFRGDGNGNGNGLPWILLRWLFRRG

SEQ ID NO: 1282 - protein, 35 aa, Artificial Sequence
  Antimicrobial peptide sequence
GLARILLRLLFFRGDSGSGSGGLPWILLRWLFFRG

SEQ ID NO: 1283 - protein, 35 aa, Artificial Sequence
  Antimicrobial peptide sequence
GLARILLRLLFFRGDSGSGSGGLARILLRWLFFRG

SEQ ID NO: 1284 - protein, 35 aa, Artificial Sequence
  Antimicrobial peptide sequence
GLARILLRLLFFRGDSGSGSGGLARILLRWLFRFG

SEQ ID NO: 1285 - protein, 35 aa, Artificial Sequence
  Antimicrobial peptide sequence
GLARILLRLLFFRGDSGSGSGGLVRILLRWLFRFG

SEQ ID NO: 1286 - protein, 35 aa, Artificial Sequence
  Antimicrobial peptide sequence
GLARILLRLLFFRGDSGSGSGGLARILLRLLFFRG

SEQ ID NO: 1287 - protein, 35 aa, Artificial Sequence
  Antimicrobial peptide sequence
GLARILLRLLFFRGDSGSGSGGLARILLRLLFRFG

SEQ ID NO: 1288 - protein, 35 aa, Artificial Sequence
  Antimicrobial peptide sequence
GLARILLRLLFFRGDSGSGSGGLVRILLRLLFRFG

SEQ ID NO: 1289 - protein, 35 aa, Artificial Sequence
  Antimicrobial peptide sequence
GLARILLRLLFFRGDSGSGSGSLVRILLRLLLRFG

SEQ ID NO: 1290 - protein, 35 aa, Artificial Sequence
  Antimicrobial peptide sequence
GLARILLRLLFFRGDSGSGSGGLVRILLRLLLRYG

SEQ ID NO: 1291 - protein, 35 aa, Artificial Sequence
  Antimicrobial peptide sequence
GLARILLRLLFFRGDSGSGSGGLAWILLRWLFFRG

SEQ ID NO: 1292 - protein, 35 aa, Artificial Sequence
  Antimicrobial peptide sequence
GLARILLRLLFFRGDSGSGSGGLVRILLRWLFFRG

SEQ ID NO: 1293 - protein, 35 aa, Artificial Sequence
  Antimicrobial peptide sequence
GLARILLRLLFFRGDSGSGSGGLLRILLRWLFFRG

SEQ ID NO: 1294 - protein, 35 aa, Artificial Sequence
  Antimicrobial peptide sequence
GLARILLRLLFFRGDSGSGSGGLPWILLRWLFRFG

SEQ ID NO: 1295 - protein, 35 aa, Artificial Sequence
  Antimicrobial peptide sequence
GLARILLRLLFFRGDSGSGSGGLLRILLRWLFRFG

SEQ ID NO: 1296 - protein, 35 aa, Artificial Sequence
  Antimicrobial peptide sequence
GLARILLRLLFFRGDSGSGSGGLPWILLRWLFRRG

SEQ ID NO: 1297 - protein, 35 aa, Artificial Sequence
  Antimicrobial peptide sequence
GLARILLRLLFFRGDGSGSGSGLPWILLRWLFFRG

SEQ ID NO: 1298 - protein, 35 aa, Artificial Sequence
  Antimicrobial peptide sequence
GLARILLRLLFFRGDGSGSGSGLARILLRWLFFRG

SEQ ID NO: 1299 - protein, 35 aa, Artificial Sequence
  Antimicrobial peptide sequence
GLARILLRLLFFRGDGSGSGSGLARILLRWLFRFG

SEQ ID NO: 1300 - protein, 35 aa, Artificial Sequence
  Antimicrobial peptide sequence
GLARILLRLLFFRGDGSGSGSGLVRILLRWLFRFG

SEQ ID NO: 1301 - protein, 35 aa, Artificial Sequence
  Antimicrobial peptide sequence
GLARILLRLLFFRGDGSGSGSGLARILLRLLFFRG

SEQ ID NO: 1302 - protein, 35 aa, Artificial Sequence
  Antimicrobial peptide sequence
GLARILLRLLFFRGDGSGSGSGLARILLRLLFRFG

SEQ ID NO: 1303 - protein, 35 aa, Artificial Sequence
  Antimicrobial peptide sequence
GLARILLRLLFFRGDGSGSGSGLVRILLRLLFRFG

SEQ ID NO: 1304 - protein, 35 aa, Artificial Sequence
  Antimicrobial peptide sequence
GLARILLRLLFFRGDGSGSGSSLVRILLRLLLRFG

SEQ ID NO: 1305 - protein, 35 aa, Artificial Sequence
  Antimicrobial peptide sequence
GLARILLRLLFFRGDGSGSGSGLVRILLRLLLRYG

SEQ ID NO: 1306 - protein, 35 aa, Artificial Sequence
  Antimicrobial peptide sequence
GLARILLRLLFFRGDGSGSGSGLAWILLRWLFFRG

SEQ ID NO: 1307 - protein, 35 aa, Artificial Sequence
  Antimicrobial peptide sequence
GLARILLRLLFFRGDGSGSGSGLVRILLRWLFFRG

SEQ ID NO: 1308 - protein, 35 aa, Artificial Sequence
  Antimicrobial peptide sequence
GLARILLRLLFFRGDGSGSGSGLLRILLRWLFFRG

SEQ ID NO: 1309 - protein, 35 aa, Artificial Sequence
  Antimicrobial peptide sequence
GLARILLRLLFFRGDGSGSGSGLPWILLRWLFRFG

SEQ ID NO: 1310 - protein, 35 aa, Artificial Sequence
  Antimicrobial peptide sequence
GLARILLRLLFFRGDGSGSGSGLLRILLRWLFRFG

SEQ ID NO: 1311 - protein, 35 aa, Artificial Sequence
  Antimicrobial peptide sequence
GLARILLRLLFFRGDGSGSGSGLPWILLRWLFRRG

SEQ ID NO: 1312 - protein, 35 aa, Artificial Sequence
  Antimicrobial peptide sequence
GLARILLRLLFFRGDSNSNSNGLPWILLRWLFFRG

SEQ ID NO: 1313 - protein, 35 aa, Artificial Sequence
  Antimicrobial peptide sequence
GLARILLRLLFFRGDSNSNSNGLARILLRWLFFRG

SEQ ID NO: 1314 - protein, 35 aa, Artificial Sequence
  Antimicrobial peptide sequence
GLARILLRLLFFRGDSNSNSNGLARILLRWLFRFG

SEQ ID NO: 1315 - protein, 35 aa, Artificial Sequence
  Antimicrobial peptide sequence
GLARILLRLLFFRGDSNSNSNGLVRILLRWLFRFG

SEQ ID NO: 1316 - protein, 35 aa, Artificial Sequence
  Antimicrobial peptide sequence
GLARILLRLLFFRGDSNSNSNGLARILLRLLFFRG

SEQ ID NO: 1317 - protein, 35 aa, Artificial Sequence
  Antimicrobial peptide sequence
GLARILLRLLFFRGDSNSNSNGLARILLRLLFRFG

SEQ ID NO: 1318 - protein, 35 aa, Artificial Sequence
  Antimicrobial peptide sequence
GLARILLRLLFFRGDSNSNSNGLVRILLRLLFRFG

SEQ ID NO: 1319 - protein, 35 aa, Artificial Sequence
  Antimicrobial peptide sequence
GLARILLRLLFFRGDSNSNSNSLVRILLRLLLRFG

SEQ ID NO: 1320 - protein, 35 aa, Artificial Sequence
  Antimicrobial peptide sequence
GLARILLRLLFFRGDSNSNSNGLVRILLRLLLRYG

SEQ ID NO: 1321 - protein, 35 aa, Artificial Sequence
  Antimicrobial peptide sequence
GLARILLRLLFFRGDSNSNSNGLAWILLRWLFFRG

SEQ ID NO: 1322 - protein, 35 aa, Artificial Sequence
  Antimicrobial peptide sequence
GLARILLRLLFFRGDSNSNSNGLVRILLRWLFFRG

SEQ ID NO: 1323 - protein, 35 aa, Artificial Sequence
  Antimicrobial peptide sequence
GLARILLRLLFFRGDSNSNSNGLLRILLRWLFFRG

SEQ ID NO: 1324 - protein, 35 aa, Artificial Sequence
  Antimicrobial peptide sequence
GLARILLRLLFFRGDSNSNSNGLPWILLRWLFRFG

SEQ ID NO: 1325 - protein, 35 aa, Artificial Sequence
  Antimicrobial peptide sequence
GLARILLRLLFFRGDSNSNSNGLLRILLRWLFRFG

SEQ ID NO: 1326 - protein, 35 aa, Artificial Sequence
  Antimicrobial peptide sequence
GLARILLRLLFFRGDSNSNSNGLPWILLRWLFRRG

SEQ ID NO: 1327 - protein, 35 aa, Artificial Sequence
  Antimicrobial peptide sequence
GLARILLRLLFFRGDNSNSNSGLPWILLRWLFFRG

SEQ ID NO: 1328 - protein, 35 aa, Artificial Sequence
  Antimicrobial peptide sequence
GLARILLRLLFFRGDNSNSNSGLARILLRWLFFRG

SEQ ID NO: 1329 - protein, 35 aa, Artificial Sequence
  Antimicrobial peptide sequence
GLARILLRLLFFRGDNSNSNSGLARILLRWLFRFG

SEQ ID NO: 1330 - protein, 35 aa, Artificial Sequence
  Antimicrobial peptide sequence
GLARILLRLLFFRGDNSNSNSGLVRILLRWLFRFG

SEQ ID NO: 1331 - protein, 35 aa, Artificial Sequence
  Antimicrobial peptide sequence
GLARILLRLLFFRGDNSNSNSGLARILLRLLFFRG

SEQ ID NO: 1332 - protein, 35 aa, Artificial Sequence
  Antimicrobial peptide sequence
GLARILLRLLFFRGDNSNSNSGLARILLRLLFRFG

SEQ ID NO: 1333 - protein, 35 aa, Artificial Sequence
  Antimicrobial peptide sequence
GLARILLRLLFFRGDNSNSNSGLVRILLRLLFRFG

SEQ ID NO: 1334 - protein, 35 aa, Artificial Sequence
  Antimicrobial peptide sequence
GLARILLRLLFFRGDNSNSNSSLVRILLRLLLRFG

SEQ ID NO: 1335 - protein, 35 aa, Artificial Sequence
  Antimicrobial peptide sequence
GLARILLRLLFFRGDNSNSNSGLVRILLRLLLRYG

SEQ ID NO: 1336 - protein, 35 aa, Artificial Sequence
  Antimicrobial peptide sequence
GLARILLRLLFFRGDNSNSNSGLAWILLRWLFFRG

SEQ ID NO: 1337 - protein, 35 aa, Artificial Sequence
  Antimicrobial peptide sequence
GLARILLRLLFFRGDNSNSNSGLVRILLRWLFFRG

SEQ ID NO: 1338 - protein, 35 aa, Artificial Sequence
  Antimicrobial peptide sequence
GLARILLRLLFFRGDNSNSNSGLLRILLRWLFFRG

SEQ ID NO: 1339 - protein, 35 aa, Artificial Sequence
  Antimicrobial peptide sequence
GLARILLRLLFFRGDNSNSNSGLPWILLRWLFRFG

SEQ ID NO: 1340 - protein, 35 aa, Artificial Sequence
  Antimicrobial peptide sequence
GLARILLRLLFFRGDNSNSNSGLLRILLRWLFRFG

SEQ ID NO: 1341 - protein, 35 aa, Artificial Sequence
  Antimicrobial peptide sequence
GLARILLRLLFFRGDNSNSNSGLPWILLRWLFRRG

SEQ ID NO: 1342 - protein, 35 aa, Artificial Sequence
  Antimicrobial peptide sequence
GLARILLRLLFFRGDHGHGHGGLPWILLRWLFFRG

SEQ ID NO: 1343 - protein, 35 aa, Artificial Sequence
  Antimicrobial peptide sequence
GLARILLRLLFFRGDHGHGHGGLARILLRWLFFRG

SEQ ID NO: 1344 - protein, 35 aa, Artificial Sequence
  Antimicrobial peptide sequence
GLARILLRLLFFRGDHGHGHGGLARILLRWLFRFG

SEQ ID NO: 1345 - protein, 35 aa, Artificial Sequence
  Antimicrobial peptide sequence
GLARILLRLLFFRGDHGHGHGGLVRILLRWLFRFG

SEQ ID NO: 1346 - protein, 35 aa, Artificial Sequence
  Antimicrobial peptide sequence
GLARILLRLLFFRGDHGHGHGGLARILLRLLFFRG

SEQ ID NO: 1347 - protein, 35 aa, Artificial Sequence
  Antimicrobial peptide sequence
GLARILLRLLFFRGDHGHGHGGLARILLRLLFRFG

SEQ ID NO: 1348 - protein, 35 aa, Artificial Sequence
  Antimicrobial peptide sequence
GLARILLRLLFFRGDHGHGHGGLVRILLRLLFRFG

SEQ ID NO: 1349 - protein, 35 aa, Artificial Sequence
  Antimicrobial peptide sequence
GLARILLRLLFFRGDHGHGHGSLVRILLRLLLRFG

SEQ ID NO: 1350 - protein, 35 aa, Artificial Sequence
  Antimicrobial peptide sequence
GLARILLRLLFFRGDHGHGHGGLVRILLRLLLRYG

SEQ ID NO: 1351 - protein, 35 aa, Artificial Sequence
  Antimicrobial peptide sequence
GLARILLRLLFFRGDHGHGHGGLAWILLRWLFFRG

SEQ ID NO: 1352 - protein, 35 aa, Artificial Sequence
  Antimicrobial peptide sequence
GLARILLRLLFFRGDHGHGHGGLVRILLRWLFFRG

SEQ ID NO: 1353 - protein, 35 aa, Artificial Sequence
  Antimicrobial peptide sequence
GLARILLRLLFFRGDHGHGHGGLLRILLRWLFFRG

SEQ ID NO: 1354 - protein, 35 aa, Artificial Sequence
  Antimicrobial peptide sequence
GLARILLRLLFFRGDHGHGHGGLPWILLRWLFRFG

SEQ ID NO: 1355 - protein, 35 aa, Artificial Sequence
  Antimicrobial peptide sequence
GLARILLRLLFFRGDHGHGHGGLLRILLRWLFRFG

SEQ ID NO: 1356 - protein, 35 aa, Artificial Sequence
  Antimicrobial peptide sequence
GLARILLRLLFFRGDHGHGHGGLPWILLRWLFRRG

SEQ ID NO: 1357 - protein, 35 aa, Artificial Sequence
  Antimicrobial peptide sequence
GLARILLRLLFFRGDGHGHGHGLPWILLRWLFFRG

SEQ ID NO: 1358 - protein, 35 aa, Artificial Sequence
  Antimicrobial peptide sequence
GLARILLRLLFFRGDGHGHGHGLARILLRWLFFRG

SEQ ID NO: 1359 - protein, 35 aa, Artificial Sequence
  Antimicrobial peptide sequence
GLARILLRLLFFRGDGHGHGHGLARILLRWLFRFG

SEQ ID NO: 1360 - protein, 35 aa, Artificial Sequence
  Antimicrobial peptide sequence
GLARILLRLLFFRGDGHGHGHGLVRILLRWLFRFG

SEQ ID NO: 1361 - protein, 35 aa, Artificial Sequence
  Antimicrobial peptide sequence
GLARILLRLLFFRGDGHGHGHGLARILLRLLFFRG

SEQ ID NO: 1362 - protein, 35 aa, Artificial Sequence
  Antimicrobial peptide sequence
GLARILLRLLFFRGDGHGHGHGLARILLRLLFRFG

SEQ ID NO: 1363 - protein, 35 aa, Artificial Sequence
  Antimicrobial peptide sequence
GLARILLRLLFFRGDGHGHGHGLVRILLRLLFRFG

SEQ ID NO: 1364 - protein, 35 aa, Artificial Sequence
  Antimicrobial peptide sequence
GLARILLRLLFFRGDGHGHGHSLVRILLRLLLRFG

SEQ ID NO: 1365 - protein, 35 aa, Artificial Sequence
  Antimicrobial peptide sequence
GLARILLRLLFFRGDGHGHGHGLVRILLRLLLRYG

SEQ ID NO: 1366 - protein, 35 aa, Artificial Sequence
  Antimicrobial peptide sequence
GLARILLRLLFFRGDGHGHGHGLAWILLRWLFFRG

SEQ ID NO: 1367 - protein, 35 aa, Artificial Sequence
  Antimicrobial peptide sequence
GLARILLRLLFFRGDGHGHGHGLVRILLRWLFFRG

SEQ ID NO: 1368 - protein, 35 aa, Artificial Sequence
  Antimicrobial peptide sequence
GLARILLRLLFFRGDGHGHGHGLLRILLRWLFFRG

SEQ ID NO: 1369 - protein, 35 aa, Artificial Sequence
  Antimicrobial peptide sequence
GLARILLRLLFFRGDGHGHGHGLPWILLRWLFRFG

SEQ ID NO: 1370 - protein, 35 aa, Artificial Sequence
  Antimicrobial peptide sequence
GLARILLRLLFFRGDGHGHGHGLLRILLRWLFRFG

SEQ ID NO: 1371 - protein, 35 aa, Artificial Sequence
  Antimicrobial peptide sequence
GLARILLRLLFFRGDGHGHGHGLPWILLRWLFRRG

SEQ ID NO: 1372 - protein, 35 aa, Artificial Sequence
  Antimicrobial peptide sequence
GLARILLRLLFFRGDHNHNHNGLPWILLRWLFFRG

SEQ ID NO: 1373 - protein, 35 aa, Artificial Sequence
  Antimicrobial peptide sequence
GLARILLRLLFFRGDHNHNHNGLARILLRWLFFRG

SEQ ID NO: 1374 - protein, 35 aa, Artificial Sequence
  Antimicrobial peptide sequence
GLARILLRLLFFRGDHNHNHNGLARILLRWLFRFG

SEQ ID NO: 1375 - protein, 35 aa, Artificial Sequence
  Antimicrobial peptide sequence
GLARILLRLLFFRGDHNHNHNGLVRILLRWLFRFG

SEQ ID NO: 1376 - protein, 35 aa, Artificial Sequence
  Antimicrobial peptide sequence
GLARILLRLLFFRGDHNHNHNGLARILLRLLFFRG

SEQ ID NO: 1377 - protein, 35 aa, Artificial Sequence
  Antimicrobial peptide sequence
GLARILLRLLFFRGDHNHNHNGLARILLRLLFRFG

SEQ ID NO: 1378 - protein, 35 aa, Artificial Sequence
  Antimicrobial peptide sequence
GLARILLRLLFFRGDHNHNHNGLVRILLRLLFRFG

SEQ ID NO: 1379 - protein, 35 aa, Artificial Sequence
  Antimicrobial peptide sequence
GLARILLRLLFFRGDHNHNHNSLVRILLRLLLRFG

SEQ ID NO: 1380 - protein, 35 aa, Artificial Sequence
  Antimicrobial peptide sequence
GLARILLRLLFFRGDHNHNHNGLVRILLRLLLRYG

SEQ ID NO: 1381 - protein, 35 aa, Artificial Sequence
  Antimicrobial peptide sequence
GLARILLRLLFFRGDHNHNHNGLAWILLRWLFFRG

SEQ ID NO: 1382 - protein, 35 aa, Artificial Sequence
  Antimicrobial peptide sequence
GLARILLRLLFFRGDHNHNHNGLVRILLRWLFFRG

SEQ ID NO: 1383 - protein, 35 aa, Artificial Sequence
  Antimicrobial peptide sequence
GLARILLRLLFFRGDHNHNHNGLLRILLRWLFFRG

SEQ ID NO: 1384 - protein, 35 aa, Artificial Sequence
  Antimicrobial peptide sequence
GLARILLRLLFFRGDHNHNHNGLPWILLRWLFRFG

SEQ ID NO: 1385 - protein, 35 aa, Artificial Sequence
  Antimicrobial peptide sequence
GLARILLRLLFFRGDHNHNHNGLLRILLRWLFRFG

SEQ ID NO: 1386 - protein, 35 aa, Artificial Sequence
  Antimicrobial peptide sequence
GLARILLRLLFFRGDHNHNHNGLPWILLRWLFRRG

SEQ ID NO: 1387 - protein, 35 aa, Artificial Sequence
  Antimicrobial peptide sequence
GLARILLRLLFFRGDNHNHNHGLPWILLRWLFFRG

SEQ ID NO: 1388 - protein, 35 aa, Artificial Sequence
  Antimicrobial peptide sequence
GLARILLRLLFFRGDNHNHNHGLARILLRWLFFRG

SEQ ID NO: 1389 - protein, 35 aa, Artificial Sequence
  Antimicrobial peptide sequence
GLARILLRLLFFRGDNHNHNHGLARILLRWLFRFG

SEQ ID NO: 1390 - protein, 35 aa, Artificial Sequence
  Antimicrobial peptide sequence
GLARILLRLLFFRGDNHNHNHGLVRILLRWLFRFG

SEQ ID NO: 1391 - protein, 35 aa, Artificial Sequence
  Antimicrobial peptide sequence
GLARILLRLLFFRGDNHNHNHGLARILLRLLFFRG

SEQ ID NO: 1392 - protein, 35 aa, Artificial Sequence
  Antimicrobial peptide sequence
GLARILLRLLFFRGDNHNHNHGLARILLRLLFRFG

SEQ ID NO: 1393 - protein, 35 aa, Artificial Sequence
  Antimicrobial peptide sequence
GLARILLRLLFFRGDNHNHNHGLVRILLRLLFRFG

SEQ ID NO: 1394 - protein, 35 aa, Artificial Sequence
  Antimicrobial peptide sequence
GLARILLRLLFFRGDNHNHNHSLVRILLRLLLRFG

SEQ ID NO: 1395 - protein, 35 aa, Artificial Sequence
  Antimicrobial peptide sequence
GLARILLRLLFFRGDNHNHNHGLVRILLRLLLRYG

SEQ ID NO: 1396 - protein, 35 aa, Artificial Sequence
  Antimicrobial peptide sequence
GLARILLRLLFFRGDNHNHNHGLAWILLRWLFFRG

SEQ ID NO: 1397 - protein, 35 aa, Artificial Sequence
  Antimicrobial peptide sequence
GLARILLRLLFFRGDNHNHNHGLVRILLRWLFFRG

SEQ ID NO: 1398 - protein, 35 aa, Artificial Sequence
  Antimicrobial peptide sequence
GLARILLRLLFFRGDNHNHNHGLLRILLRWLFFRG

SEQ ID NO: 1399 - protein, 35 aa, Artificial Sequence
  Antimicrobial peptide sequence
GLARILLRLLFFRGDNHNHNHGLPWILLRWLFRFG

SEQ ID NO: 1400 - protein, 35 aa, Artificial Sequence
  Antimicrobial peptide sequence
GLARILLRLLFFRGDNHNHNHGLLRILLRWLFRFG

SEQ ID NO: 1401 - protein, 35 aa, Artificial Sequence
  Antimicrobial peptide sequence
GLARILLRLLFFRGDNHNHNHGLPWILLRWLFRRG

SEQ ID NO: 1402 - protein, 33 aa, Artificial Sequence
  Antimicrobial peptide sequence
GLARILLRLLFRFGDGGGGGLPWILLRWLFFRG

SEQ ID NO: 1403 - protein, 33 aa, Artificial Sequence
  Antimicrobial peptide sequence
GLARILLRLLFRFGDGGGGGLARILLRWLFFRG

SEQ ID NO: 1404 - protein, 33 aa, Artificial Sequence
  Antimicrobial peptide sequence
GLARILLRLLFRFGDGGGGGLARILLRWLFRFG

SEQ ID NO: 1405 - protein, 33 aa, Artificial Sequence
  Antimicrobial peptide sequence
GLARILLRLLFRFGDGGGGGLVRILLRWLFRFG

SEQ ID NO: 1406 - protein, 33 aa, Artificial Sequence
  Antimicrobial peptide sequence
GLARILLRLLFRFGDGGGGGLARILLRLLFFRG

SEQ ID NO: 1407 - protein, 33 aa, Artificial Sequence
  Antimicrobial peptide sequence
GLARILLRLLFRFGDGGGGGLARILLRLLFRFG

SEQ ID NO: 1408 - protein, 33 aa, Artificial Sequence
  Antimicrobial peptide sequence
GLARILLRLLFRFGDGGGGGLVRILLRLLFRFG

SEQ ID NO: 1409 - protein, 33 aa, Artificial Sequence
  Antimicrobial peptide sequence
GLARILLRLLFRFGDGGGGSLVRILLRLLLRFG

SEQ ID NO: 1410 - protein, 33 aa, Artificial Sequence
  Antimicrobial peptide sequence
GLARILLRLLFRFGDGGGGGLVRILLRLLLRYG

SEQ ID NO: 1411 - protein, 33 aa, Artificial Sequence
  Antimicrobial peptide sequence
GLARILLRLLFRFGDGGGGGLAWILLRWLFFRG

SEQ ID NO: 1412 - protein, 33 aa, Artificial Sequence
  Antimicrobial peptide sequence
GLARILLRLLFRFGDGGGGGLVRILLRWLFFRG

SEQ ID NO: 1413 - protein, 33 aa, Artificial Sequence
  Antimicrobial peptide sequence
GLARILLRLLFRFGDGGGGGLLRILLRWLFFRG

SEQ ID NO: 1414 - protein, 33 aa, Artificial Sequence
  Antimicrobial peptide sequence
GLARILLRLLFRFGDGGGGGLPWILLRWLFRFG

SEQ ID NO: 1415 - protein, 33 aa, Artificial Sequence
  Antimicrobial peptide sequence
GLARILLRLLFRFGDGGGGGLLRILLRWLFRFG

SEQ ID NO: 1416 - protein, 33 aa, Artificial Sequence
  Antimicrobial peptide sequence
GLARILLRLLFRFGDGGGGGLPWILLRWLFRRG

SEQ ID NO: 1417 - protein, 34 aa, Artificial Sequence
  Antimicrobial peptide sequence
GLARILLRLLFRFGDGGGGGGLPWILLRWLFFRG

SEQ ID NO: 1418 - protein, 34 aa, Artificial Sequence
  Antimicrobial peptide sequence
GLARILLRLLFRFGDGGGGGGLARILLRWLFFRG

SEQ ID NO: 1419 - protein, 34 aa, Artificial Sequence
  Antimicrobial peptide sequence
GLARILLRLLFRFGDGGGGGGLARILLRWLFRFG

SEQ ID NO: 1420 - protein, 34 aa, Artificial Sequence
  Antimicrobial peptide sequence
GLARILLRLLFRFGDGGGGGGLVRILLRWLFRFG

SEQ ID NO: 1421 - protein, 34 aa, Artificial Sequence
  Antimicrobial peptide sequence
GLARILLRLLFRFGDGGGGGGLARILLRLLFFRG

SEQ ID NO: 1422 - protein, 34 aa, Artificial Sequence
  Antimicrobial peptide sequence
GLARILLRLLFRFGDGGGGGGLARILLRLLFRFG

SEQ ID NO: 1423 - protein, 34 aa, Artificial Sequence
  Antimicrobial peptide sequence
GLARILLRLLFRFGDGGGGGGLVRILLRLLFRFG

SEQ ID NO: 1424 - protein, 34 aa, Artificial Sequence
  Antimicrobial peptide sequence
GLARILLRLLFRFGDGGGGGSLVRILLRLLLRFG

SEQ ID NO: 1425 - protein, 34 aa, Artificial Sequence
  Antimicrobial peptide sequence
GLARILLRLLFRFGDGGGGGGLVRILLRLLLRYG

SEQ ID NO: 1426 - protein, 34 aa, Artificial Sequence
  Antimicrobial peptide sequence
GLARILLRLLFRFGDGGGGGGLAWILLRWLFFRG

SEQ ID NO: 1427 - protein, 34 aa, Artificial Sequence
  Antimicrobial peptide sequence
GLARILLRLLFRFGDGGGGGGLVRILLRWLFFRG

SEQ ID NO: 1428 - protein, 34 aa, Artificial Sequence
  Antimicrobial peptide sequence
GLARILLRLLFRFGDGGGGGGLLRILLRWLFFRG

SEQ ID NO: 1429 - protein, 34 aa, Artificial Sequence
  Antimicrobial peptide sequence
GLARILLRLLFRFGDGGGGGGLPWILLRWLFRFG

SEQ ID NO: 1430 - protein, 34 aa, Artificial Sequence
  Antimicrobial peptide sequence
GLARILLRLLFRFGDGGGGGGLLRILLRWLFRFG

SEQ ID NO: 1431 - protein, 34 aa, Artificial Sequence
  Antimicrobial peptide sequence
GLARILLRLLFRFGDGGGGGGLPWILLRWLFRRG

SEQ ID NO: 1432 - protein, 35 aa, Artificial Sequence
  Antimicrobial peptide sequence
GLARILLRLLFRFGDGGGGGGGLPWILLRWLFFRG

SEQ ID NO: 1433 - protein, 35 aa, Artificial Sequence
  Antimicrobial peptide sequence
GLARILLRLLFRFGDGGGGGGGLARILLRWLFFRG

SEQ ID NO: 1434 - protein, 35 aa, Artificial Sequence
  Antimicrobial peptide sequence
GLARILLRLLFRFGDGGGGGGGLARILLRWLFRFG

SEQ ID NO: 1435 - protein, 35 aa, Artificial Sequence
  Antimicrobial peptide sequence
GLARILLRLLFRFGDGGGGGGGLVRILLRWLFRFG

SEQ ID NO: 1436 - protein, 35 aa, Artificial Sequence
  Antimicrobial peptide sequence
GLARILLRLLFRFGDGGGGGGGLARILLRLLFFRG

SEQ ID NO: 1437 - protein, 35 aa, Artificial Sequence
  Antimicrobial peptide sequence
GLARILLRLLFRFGDGGGGGGGLARILLRLLFRFG

SEQ ID NO: 1438 - protein, 35 aa, Artificial Sequence
  Antimicrobial peptide sequence
GLARILLRLLFRFGDGGGGGGGLVRILLRLLFRFG

SEQ ID NO: 1439 - protein, 35 aa, Artificial Sequence
  Antimicrobial peptide sequence
GLARILLRLLFRFGDGGGGGGSLVRILLRLLLRFG

SEQ ID NO: 1440 - protein, 35 aa, Artificial Sequence
  Antimicrobial peptide sequence
GLARILLRLLFRFGDGGGGGGGLVRILLRLLLRYG

SEQ ID NO: 1441 - protein, 35 aa, Artificial Sequence
  Antimicrobial peptide sequence
GLARILLRLLFRFGDGGGGGGGLAWILLRWLFFRG

SEQ ID NO: 1442 - protein, 35 aa, Artificial Sequence
  Antimicrobial peptide sequence
GLARILLRLLFRFGDGGGGGGGLVRILLRWLFFRG

SEQ ID NO: 1443 - protein, 35 aa, Artificial Sequence
  Antimicrobial peptide sequence
GLARILLRLLFRFGDGGGGGGGLLRILLRWLFFRG

SEQ ID NO: 1444 - protein, 35 aa, Artificial Sequence
  Antimicrobial peptide sequence
GLARILLRLLFRFGDGGGGGGGLPWILLRWLFRFG

SEQ ID NO: 1445 - protein, 35 aa, Artificial Sequence
  Antimicrobial peptide sequence
GLARILLRLLFRFGDGGGGGGGLLRILLRWLFRFG

SEQ ID NO: 1446 - protein, 35 aa, Artificial Sequence
  Antimicrobial peptide sequence
GLARILLRLLFRFGDGGGGGGGLPWILLRWLFRRG

SEQ ID NO: 1447 - protein, 36 aa, Artificial Sequence
  Antimicrobial peptide sequence
GLARILLRLLFRFGDGGGGGGGGLPWILLRWLFFRG

SEQ ID NO: 1448 - protein, 36 aa, Artificial Sequence
  Antimicrobial peptide sequence
GLARILLRLLFRFGDGGGGGGGGLARILLRWLFFRG

SEQ ID NO: 1449 - protein, 36 aa, Artificial Sequence
  Antimicrobial peptide sequence
GLARILLRLLFRFGDGGGGGGGGLARILLRWLFRFG

SEQ ID NO: 1450 - protein, 36 aa, Artificial Sequence
  Antimicrobial peptide sequence
GLARILLRLLFRFGDGGGGGGGGLVRILLRWLFRFG

SEQ ID NO: 1451 - protein, 36 aa, Artificial Sequence
  Antimicrobial peptide sequence
GLARILLRLLFRFGDGGGGGGGGLARILLRLLFFRG

SEQ ID NO: 1452 - protein, 36 aa, Artificial Sequence
  Antimicrobial peptide sequence
GLARILLRLLFRFGDGGGGGGGGLARILLRLLFRFG

SEQ ID NO: 1453 - protein, 36 aa, Artificial Sequence
  Antimicrobial peptide sequence
GLARILLRLLFRFGDGGGGGGGGLVRILLRLLFRFG

SEQ ID NO: 1454 - protein, 36 aa, Artificial Sequence
  Antimicrobial peptide sequence
GLARILLRLLFRFGDGGGGGGGSLVRILLRLLLRFG

SEQ ID NO: 1455 - protein, 36 aa, Artificial Sequence
  Antimicrobial peptide sequence
GLARILLRLLFRFGDGGGGGGGGLVRILLRLLLRYG

SEQ ID NO: 1456 - protein, 36 aa, Artificial Sequence
  Antimicrobial peptide sequence
GLARILLRLLFRFGDGGGGGGGGLAWILLRWLFFRG

SEQ ID NO: 1457 - protein, 36 aa, Artificial Sequence
  Antimicrobial peptide sequence
GLARILLRLLFRFGDGGGGGGGGLVRILLRWLFFRG

SEQ ID NO: 1458 - protein, 36 aa, Artificial Sequence
  Antimicrobial peptide sequence
GLARILLRLLFRFGDGGGGGGGGLLRILLRWLFFRG

SEQ ID NO: 1459 - protein, 36 aa, Artificial Sequence
  Antimicrobial peptide sequence
GLARILLRLLFRFGDGGGGGGGGLPWILLRWLFRFG

SEQ ID NO: 1460 - protein, 36 aa, Artificial Sequence
  Antimicrobial peptide sequence
GLARILLRLLFRFGDGGGGGGGGLLRILLRWLFRFG

SEQ ID NO: 1461 - protein, 36 aa, Artificial Sequence
  Antimicrobial peptide sequence
GLARILLRLLFRFGDGGGGGGGGLPWILLRWLFRRG

SEQ ID NO: 1462 - protein, 33 aa, Artificial Sequence
  Antimicrobial peptide sequence
GLARILLRLLFRFGDNNNNGLPWILLRWLFFRG

SEQ ID NO: 1463 - protein, 33 aa, Artificial Sequence
  Antimicrobial peptide sequence
GLARILLRLLFRFGDNNNNGLARILLRWLFFRG

SEQ ID NO: 1464 - protein, 33 aa, Artificial Sequence
  Antimicrobial peptide sequence
GLARILLRLLFRFGDNNNNGLARILLRWLFRFG

SEQ ID NO: 1465 - protein, 33 aa, Artificial Sequence
  Antimicrobial peptide sequence
GLARILLRLLFRFGDNNNNGLVRILLRWLFRFG

SEQ ID NO: 1466 - protein, 33 aa, Artificial Sequence
  Antimicrobial peptide sequence
GLARILLRLLFRFGDNNNNGLARILLRLLFFRG

SEQ ID NO: 1467 - protein, 33 aa, Artificial Sequence
  Antimicrobial peptide sequence
GLARILLRLLFRFGDNNNNGLARILLRLLFRFG

SEQ ID NO: 1468 - protein, 33 aa, Artificial Sequence
  Antimicrobial peptide sequence
GLARILLRLLFRFGDNNNNGLVRILLRLLFRFG

SEQ ID NO: 1469 - protein, 33 aa, Artificial Sequence
  Antimicrobial peptide sequence
GLARILLRLLFRFGDNNNNSLVRILLRLLLRFG

SEQ ID NO: 1470 - protein, 33 aa, Artificial Sequence
  Antimicrobial peptide sequence
GLARILLRLLFRFGDNNNNGLVRILLRLLLRYG

SEQ ID NO: 1471 - protein, 33 aa, Artificial Sequence
  Antimicrobial peptide sequence
GLARILLRLLFRFGDNNNNGLAWILLRWLFFRG

SEQ ID NO: 1472 - protein, 33 aa, Artificial Sequence
  Antimicrobial peptide sequence
GLARILLRLLFRFGDNNNNGLVRILLRWLFFRG

SEQ ID NO: 1473 - protein, 33 aa, Artificial Sequence
  Antimicrobial peptide sequence
GLARILLRLLFRFGDNNNNGLLRILLRWLFFRG

SEQ ID NO: 1474 - protein, 33 aa, Artificial Sequence
  Antimicrobial peptide sequence
GLARILLRLLFRFGDNNNNGLPWILLRWLFRFG

SEQ ID NO: 1475 - protein, 33 aa, Artificial Sequence
  Antimicrobial peptide sequence
GLARILLRLLFRFGDNNNNGLLRILLRWLFRFG

SEQ ID NO: 1476 - protein, 33 aa, Artificial Sequence
  Antimicrobial peptide sequence
GLARILLRLLFRFGDNNNNGLPWILLRWLFRRG

SEQ ID NO: 1477 - protein, 34 aa, Artificial Sequence
  Antimicrobial peptide sequence
GLARILLRLLFRFGDNNNNNGLPWILLRWLFFRG

SEQ ID NO: 1478 - protein, 34 aa, Artificial Sequence
  Antimicrobial peptide sequence
GLARILLRLLFRFGDNNNNNGLARILLRWLFFRG

SEQ ID NO: 1479 - protein, 34 aa, Artificial Sequence
  Antimicrobial peptide sequence
GLARILLRLLFRFGDNNNNNGLARILLRWLFRFG

SEQ ID NO: 1480 - protein, 34 aa, Artificial Sequence
  Antimicrobial peptide sequence
GLARILLRLLFRFGDNNNNNGLVRILLRWLFRFG

SEQ ID NO: 1481 - protein, 34 aa, Artificial Sequence
  Antimicrobial peptide sequence
GLARILLRLLFRFGDNNNNNGLARILLRLLFFRG

SEQ ID NO: 1482 - protein, 34 aa, Artificial Sequence
  Antimicrobial peptide sequence
GLARILLRLLFRFGDNNNNNGLARILLRLLFRFG

SEQ ID NO: 1483 - protein, 34 aa, Artificial Sequence
  Antimicrobial peptide sequence
GLARILLRLLFRFGDNNNNNGLVRILLRLLFRFG

SEQ ID NO: 1484 - protein, 34 aa, Artificial Sequence
  Antimicrobial peptide sequence
GLARILLRLLFRFGDNNNNNSLVRILLRLLLRFG

SEQ ID NO: 1485 - protein, 34 aa, Artificial Sequence
  Antimicrobial peptide sequence
GLARILLRLLFRFGDNNNNNGLVRILLRLLLRYG

SEQ ID NO: 1486 - protein, 34 aa, Artificial Sequence
  Antimicrobial peptide sequence
GLARILLRLLFRFGDNNNNNGLAWILLRWLFFRG

SEQ ID NO: 1487 - protein, 34 aa, Artificial Sequence
  Antimicrobial peptide sequence
GLARILLRLLFRFGDNNNNNGLVRILLRWLFFRG

SEQ ID NO: 1488 - protein, 34 aa, Artificial Sequence
  Antimicrobial peptide sequence
GLARILLRLLFRFGDNNNNNGLLRILLRWLFFRG

SEQ ID NO: 1489 - protein, 34 aa, Artificial Sequence
  Antimicrobial peptide sequence
GLARILLRLLFRFGDNNNNNGLPWILLRWLFRFG

SEQ ID NO: 1490 - protein, 34 aa, Artificial Sequence
  Antimicrobial peptide sequence
GLARILLRLLFRFGDNNNNNGLLRILLRWLFRFG

SEQ ID NO: 1491 - protein, 34 aa, Artificial Sequence
  Antimicrobial peptide sequence
GLARILLRLLFRFGDNNNNNGLPWILLRWLFRRG

SEQ ID NO: 1492 - protein, 35 aa, Artificial Sequence
  Antimicrobial peptide sequence
GLARILLRLLFRFGDNNNNNNGLPWILLRWLFFRG

SEQ ID NO: 1493 - protein, 35 aa, Artificial Sequence
  Antimicrobial peptide sequence
GLARILLRLLFRFGDNNNNNNGLARILLRWLFFRG

SEQ ID NO: 1494 - protein, 35 aa, Artificial Sequence
  Antimicrobial peptide sequence
GLARILLRLLFRFGDNNNNNNGLARILLRWLFRFG

SEQ ID NO: 1495 - protein, 35 aa, Artificial Sequence
  Antimicrobial peptide sequence
GLARILLRLLFRFGDNNNNNNGLVRILLRWLFRFG

SEQ ID NO: 1496 - protein, 35 aa, Artificial Sequence
  Antimicrobial peptide sequence
GLARILLRLLFRFGDNNNNNNGLARILLRLLFFRG

SEQ ID NO: 1497 - protein, 35 aa, Artificial Sequence
  Antimicrobial peptide sequence
GLARILLRLLFRFGDNNNNNNGLARILLRLLFRFG

SEQ ID NO: 1498 - protein, 35 aa, Artificial Sequence
  Antimicrobial peptide sequence
GLARILLRLLFRFGDNNNNNNGLVRILLRLLFRFG

SEQ ID NO: 1499 - protein, 35 aa, Artificial Sequence
  Antimicrobial peptide sequence
GLARILLRLLFRFGDNNNNNNSLVRILLRLLLRFG

SEQ ID NO: 1500 - protein, 35 aa, Artificial Sequence
  Antimicrobial peptide sequence
GLARILLRLLFRFGDNNNNNNGLVRILLRLLLRYG

SEQ ID NO: 1501 - protein, 35 aa, Artificial Sequence
  Antimicrobial peptide sequence
GLARILLRLLFRFGDNNNNNNGLAWILLRWLFFRG

SEQ ID NO: 1502 - protein, 35 aa, Artificial Sequence
  Antimicrobial peptide sequence
GLARILLRLLFRFGDNNNNNNGLVRILLRWLFFRG

SEQ ID NO: 1503 - protein, 35 aa, Artificial Sequence
  Antimicrobial peptide sequence
GLARILLRLLFRFGDNNNNNNGLLRILLRWLFFRG

SEQ ID NO: 1504 - protein, 35 aa, Artificial Sequence
  Antimicrobial peptide sequence
GLARILLRLLFRFGDNNNNNNGLPWILLRWLFRFG

SEQ ID NO: 1505 - protein, 35 aa, Artificial Sequence
  Antimicrobial peptide sequence
GLARILLRLLFRFGDNNNNNNGLLRILLRWLFRFG

SEQ ID NO: 1506 - protein, 35 aa, Artificial Sequence
  Antimicrobial peptide sequence
GLARILLRLLFRFGDNNNNNNGLPWILLRWLFRRG

SEQ ID NO: 1507 - protein, 36 aa, Artificial Sequence
  Antimicrobial peptide sequence
GLARILLRLLFRFGDNNNNNNNGLPWILLRWLFFRG

SEQ ID NO: 1508 - protein, 36 aa, Artificial Sequence
  Antimicrobial peptide sequence
GLARILLRLLFRFGDNNNNNNNGLARILLRWLFFRG

SEQ ID NO: 1509 - protein, 36 aa, Artificial Sequence
  Antimicrobial peptide sequence
GLARILLRLLFRFGDNNNNNNNGLARILLRWLFRFG

SEQ ID NO: 1510 - protein, 36 aa, Artificial Sequence
  Antimicrobial peptide sequence
GLARILLRLLFRFGDNNNNNNNGLVRILLRWLFRFG

SEQ ID NO: 1511 - protein, 36 aa, Artificial Sequence
  Antimicrobial peptide sequence
GLARILLRLLFRFGDNNNNNNNGLARILLRLLFFRG

SEQ ID NO: 1512 - protein, 36 aa, Artificial Sequence
  Antimicrobial peptide sequence
GLARILLRLLFRFGDNNNNNNNGLARILLRLLFRFG

SEQ ID NO: 1513 - protein, 36 aa, Artificial Sequence
  Antimicrobial peptide sequence
GLARILLRLLFRFGDNNNNNNNGLVRILLRLLFRFG

SEQ ID NO: 1514 - protein, 36 aa, Artificial Sequence
  Antimicrobial peptide sequence
GLARILLRLLFRFGDNNNNNNNSLVRILLRLLLRFG

SEQ ID NO: 1515 - protein, 36 aa, Artificial Sequence
  Antimicrobial peptide sequence
GLARILLRLLFRFGDNNNNNNNGLVRILLRLLLRYG

SEQ ID NO: 1516 - protein, 36 aa, Artificial Sequence
  Antimicrobial peptide sequence
GLARILLRLLFRFGDNNNNNNNGLAWILLRWLFFRG

SEQ ID NO: 1517 - protein, 36 aa, Artificial Sequence
  Antimicrobial peptide sequence
GLARILLRLLFRFGDNNNNNNNGLVRILLRWLFFRG

SEQ ID NO: 1518 - protein, 36 aa, Artificial Sequence
  Antimicrobial peptide sequence
GLARILLRLLFRFGDNNNNNNNGLLRILLRWLFFRG

SEQ ID NO: 1519 - protein, 36 aa, Artificial Sequence
  Antimicrobial peptide sequence
GLARILLRLLFRFGDNNNNNNNGLPWILLRWLFRFG

SEQ ID NO: 1520 - protein, 36 aa, Artificial Sequence
  Antimicrobial peptide sequence
GLARILLRLLFRFGDNNNNNNNGLLRILLRWLFRFG

SEQ ID NO: 1521 - protein, 36 aa, Artificial Sequence
  Antimicrobial peptide sequence
GLARILLRLLFRFGDNNNNNNNGLPWILLRWLFRRG

SEQ ID NO: 1522 - protein, 35 aa, Artificial Sequence
  Antimicrobial peptide sequence
GLARILLRLLFRFGDNGNGNGGLPWILLRWLFFRG

SEQ ID NO: 1523 - protein, 35 aa, Artificial Sequence
  Antimicrobial peptide sequence
GLARILLRLLFRFGDNGNGNGGLARILLRWLFFRG

SEQ ID NO: 1524 - protein, 35 aa, Artificial Sequence
  Antimicrobial peptide sequence
GLARILLRLLFRFGDNGNGNGGLARILLRWLFRFG

SEQ ID NO: 1525 - protein, 35 aa, Artificial Sequence
  Antimicrobial peptide sequence
GLARILLRLLFRFGDNGNGNGGLVRILLRWLFRFG

SEQ ID NO: 1526 - protein, 35 aa, Artificial Sequence
  Antimicrobial peptide sequence
GLARILLRLLFRFGDNGNGNGGLARILLRLLFFRG

SEQ ID NO: 1527 - protein, 35 aa, Artificial Sequence
  Antimicrobial peptide sequence
GLARILLRLLFRFGDNGNGNGGLARILLRLLFRFG

SEQ ID NO: 1528 - protein, 35 aa, Artificial Sequence
  Antimicrobial peptide sequence
GLARILLRLLFRFGDNGNGNGGLVRILLRLLFRFG

SEQ ID NO: 1529 - protein, 35 aa, Artificial Sequence
  Antimicrobial peptide sequence
GLARILLRLLFRFGDNGNGNGSLVRILLRLLLRFG

SEQ ID NO: 1530 - protein, 35 aa, Artificial Sequence
  Antimicrobial peptide sequence
GLARILLRLLFRFGDNGNGNGGLVRILLRLLLRYG

SEQ ID NO: 1531 - protein, 35 aa, Artificial Sequence
  Antimicrobial peptide sequence
GLARILLRLLFRFGDNGNGNGGLAWILLRWLFFRG

SEQ ID NO: 1532 - protein, 35 aa, Artificial Sequence
  Antimicrobial peptide sequence
GLARILLRLLFRFGDNGNGNGGLVRILLRWLFFRG

SEQ ID NO: 1533 - protein, 35 aa, Artificial Sequence
  Antimicrobial peptide sequence
GLARILLRLLFRFGDNGNGNGGLLRILLRWLFFRG

SEQ ID NO: 1534 - protein, 35 aa, Artificial Sequence
  Antimicrobial peptide sequence
GLARILLRLLFRFGDNGNGNGGLPWILLRWLFRFG

SEQ ID NO: 1535 - protein, 35 aa, Artificial Sequence
  Antimicrobial peptide sequence
GLARILLRLLFRFGDNGNGNGGLLRILLRWLFRFG

SEQ ID NO: 1536 - protein, 35 aa, Artificial Sequence
  Antimicrobial peptide sequence
GLARILLRLLFRFGDNGNGNGGLPWILLRWLFRRG

SEQ ID NO: 1537 - protein, 35 aa, Artificial Sequence
  Antimicrobial peptide sequence
GLARILLRLLFRFGDGNGNGNGLPWILLRWLFFRG

SEQ ID NO: 1538 - protein, 35 aa, Artificial Sequence
  Antimicrobial peptide sequence
GLARILLRLLFRFGDGNGNGNGLARILLRWLFFRG

SEQ ID NO: 1539 - protein, 35 aa, Artificial Sequence
  Antimicrobial peptide sequence
GLARILLRLLFRFGDGNGNGNGLARILLRWLFRFG

SEQ ID NO: 1540 - protein, 35 aa, Artificial Sequence
  Antimicrobial peptide sequence
GLARILLRLLFRFGDGNGNGNGLVRILLRWLFRFG

SEQ ID NO: 1541 - protein, 35 aa, Artificial Sequence
  Antimicrobial peptide sequence
GLARILLRLLFRFGDGNGNGNGLARILLRLLFFRG

SEQ ID NO: 1542 - protein, 35 aa, Artificial Sequence
  Antimicrobial peptide sequence
GLARILLRLLFRFGDGNGNGNGLARILLRLLFRFG

SEQ ID NO: 1543 - protein, 35 aa, Artificial Sequence
  Antimicrobial peptide sequence
GLARILLRLLFRFGDGNGNGNGLVRILLRLLFRFG

SEQ ID NO: 1544 - protein, 35 aa, Artificial Sequence
  Antimicrobial peptide sequence
GLARILLRLLFRFGDGNGNGNSLVRILLRLLLRFG

SEQ ID NO: 1545 - protein, 35 aa, Artificial Sequence
  Antimicrobial peptide sequence
GLARILLRLLFRFGDGNGNGNGLVRILLRLLLRYG

SEQ ID NO: 1546 - protein, 35 aa, Artificial Sequence
  Antimicrobial peptide sequence
GLARILLRLLFRFGDGNGNGNGLAWILLRWLFFRG

SEQ ID NO: 1547 - protein, 35 aa, Artificial Sequence
  Antimicrobial peptide sequence
GLARILLRLLFRFGDGNGNGNGLVRILLRWLFFRG

SEQ ID NO: 1548 - protein, 35 aa, Artificial Sequence
  Antimicrobial peptide sequence
GLARILLRLLFRFGDGNGNGNGLLRILLRWLFFRG

SEQ ID NO: 1549 - protein, 35 aa, Artificial Sequence
  Antimicrobial peptide sequence
GLARILLRLLFRFGDGNGNGNGLPWILLRWLFRFG

SEQ ID NO: 1550 - protein, 35 aa, Artificial Sequence
  Antimicrobial peptide sequence
GLARILLRLLFRFGDGNGNGNGLLRILLRWLFRFG

SEQ ID NO: 1551 - protein, 35 aa, Artificial Sequence
  Antimicrobial peptide sequence
GLARILLRLLFRFGDGNGNGNGLPWILLRWLFRRG

SEQ ID NO: 1552 - protein, 35 aa, Artificial Sequence
  Antimicrobial peptide sequence
GLARILLRLLFRFGDSGSGSGGLPWILLRWLFFRG

SEQ ID NO: 1553 - protein, 35 aa, Artificial Sequence
  Antimicrobial peptide sequence
GLARILLRLLFRFGDSGSGSGGLARILLRWLFFRG

SEQ ID NO: 1554 - protein, 35 aa, Artificial Sequence
  Antimicrobial peptide sequence
GLARILLRLLFRFGDSGSGSGGLARILLRWLFRFG

SEQ ID NO: 1555 - protein, 35 aa, Artificial Sequence
  Antimicrobial peptide sequence
GLARILLRLLFRFGDSGSGSGGLVRILLRWLFRFG

SEQ ID NO: 1556 - protein, 35 aa, Artificial Sequence
  Antimicrobial peptide sequence
GLARILLRLLFRFGDSGSGSGGLARILLRLLFFRG

SEQ ID NO: 1557 - protein, 35 aa, Artificial Sequence
  Antimicrobial peptide sequence
GLARILLRLLFRFGDSGSGSGGLARILLRLLFRFG

SEQ ID NO: 1558 - protein, 35 aa, Artificial Sequence
  Antimicrobial peptide sequence
GLARILLRLLFRFGDSGSGSGGLVRILLRLLFRFG

SEQ ID NO: 1559 - protein, 35 aa, Artificial Sequence
  Antimicrobial peptide sequence
GLARILLRLLFRFGDSGSGSGSLVRILLRLLLRFG

SEQ ID NO: 1560 - protein, 35 aa, Artificial Sequence
  Antimicrobial peptide sequence
GLARILLRLLFRFGDSGSGSGGLVRILLRLLLRYG

SEQ ID NO: 1561 - protein, 35 aa, Artificial Sequence
  Antimicrobial peptide sequence
GLARILLRLLFRFGDSGSGSGGLAWILLRWLFFRG

SEQ ID NO: 1562 - protein, 35 aa, Artificial Sequence
  Antimicrobial peptide sequence
GLARILLRLLFRFGDSGSGSGGLVRILLRWLFFRG

SEQ ID NO: 1563 - protein, 35 aa, Artificial Sequence
  Antimicrobial peptide sequence
GLARILLRLLFRFGDSGSGSGGLLRILLRWLFFRG

SEQ ID NO: 1564 - protein, 35 aa, Artificial Sequence
  Antimicrobial peptide sequence
GLARILLRLLFRFGDSGSGSGGLPWILLRWLFRFG

SEQ ID NO: 1565 - protein, 35 aa, Artificial Sequence
  Antimicrobial peptide sequence
GLARILLRLLFRFGDSGSGSGGLLRILLRWLFRFG

SEQ ID NO: 1566 - protein, 35 aa, Artificial Sequence
  Antimicrobial peptide sequence
GLARILLRLLFRFGDSGSGSGGLPWILLRWLFRRG

SEQ ID NO: 1567 - protein, 35 aa, Artificial Sequence
  Antimicrobial peptide sequence
GLARILLRLLFRFGDGSGSGSGLPWILLRWLFFRG

SEQ ID NO: 1568 - protein, 35 aa, Artificial Sequence
  Antimicrobial peptide sequence
GLARILLRLLFRFGDGSGSGSGLARILLRWLFFRG

SEQ ID NO: 1569 - protein, 35 aa, Artificial Sequence
  Antimicrobial peptide sequence
GLARILLRLLFRFGDGSGSGSGLARILLRWLFRFG

SEQ ID NO: 1570 - protein, 35 aa, Artificial Sequence
  Antimicrobial peptide sequence
GLARILLRLLFRFGDGSGSGSGLVRILLRWLFRFG

SEQ ID NO: 1571 - protein, 35 aa, Artificial Sequence
  Antimicrobial peptide sequence
GLARILLRLLFRFGDGSGSGSGLARILLRLLFFRG

SEQ ID NO: 1572 - protein, 35 aa, Artificial Sequence
  Antimicrobial peptide sequence
GLARILLRLLFRFGDGSGSGSGLARILLRLLFRFG

SEQ ID NO: 1573 - protein, 35 aa, Artificial Sequence
  Antimicrobial peptide sequence
GLARILLRLLFRFGDGSGSGSGLVRILLRLLFRFG

SEQ ID NO: 1574 - protein, 35 aa, Artificial Sequence
  Antimicrobial peptide sequence
GLARILLRLLFRFGDGSGSGSSLVRILLRLLLRFG

SEQ ID NO: 1575 - protein, 35 aa, Artificial Sequence
  Antimicrobial peptide sequence
GLARILLRLLFRFGDGSGSGSGLVRILLRLLLRYG

SEQ ID NO: 1576 - protein, 35 aa, Artificial Sequence
  Antimicrobial peptide sequence
GLARILLRLLFRFGDGSGSGSGLAWILLRWLFFRG

SEQ ID NO: 1577 - protein, 35 aa, Artificial Sequence
  Antimicrobial peptide sequence
GLARILLRLLFRFGDGSGSGSGLVRILLRWLFFRG

SEQ ID NO: 1578 - protein, 35 aa, Artificial Sequence
  Antimicrobial peptide sequence
GLARILLRLLFRFGDGSGSGSGLLRILLRWLFFRG

SEQ ID NO: 1579 - protein, 35 aa, Artificial Sequence
  Antimicrobial peptide sequence
GLARILLRLLFRFGDGSGSGSGLPWILLRWLFRFG

SEQ ID NO: 1580 - protein, 35 aa, Artificial Sequence
  Antimicrobial peptide sequence
GLARILLRLLFRFGDGSGSGSGLLRILLRWLFRFG

SEQ ID NO: 1581 - protein, 35 aa, Artificial Sequence
  Antimicrobial peptide sequence
GLARILLRLLFRFGDGSGSGSGLPWILLRWLFRRG

SEQ ID NO: 1582 - protein, 35 aa, Artificial Sequence
  Antimicrobial peptide sequence
GLARILLRLLFRFGDSNSNSNGLPWILLRWLFFRG

SEQ ID NO: 1583 - protein, 35 aa, Artificial Sequence
  Antimicrobial peptide sequence
GLARILLRLLFRFGDSNSNSNGLARILLRWLFFRG

SEQ ID NO: 1584 - protein, 35 aa, Artificial Sequence
  Antimicrobial peptide sequence
GLARILLRLLFRFGDSNSNSNGLARILLRWLFRFG

SEQ ID NO: 1585 - protein, 35 aa, Artificial Sequence
  Antimicrobial peptide sequence
GLARILLRLLFRFGDSNSNSNGLVRILLRWLFRFG

SEQ ID NO: 1586 - protein, 35 aa, Artificial Sequence
  Antimicrobial peptide sequence
GLARILLRLLFRFGDSNSNSNGLARILLRLLFFRG

SEQ ID NO: 1587 - protein, 35 aa, Artificial Sequence
  Antimicrobial peptide sequence
GLARILLRLLFRFGDSNSNSNGLARILLRLLFRFG

SEQ ID NO: 1588 - protein, 35 aa, Artificial Sequence
  Antimicrobial peptide sequence
GLARILLRLLFRFGDSNSNSNGLVRILLRLLFRFG

SEQ ID NO: 1589 - protein, 35 aa, Artificial Sequence
  Antimicrobial peptide sequence
GLARILLRLLFRFGDSNSNSNSLVRILLRLLLRFG

SEQ ID NO: 1590 - protein, 35 aa, Artificial Sequence
  Antimicrobial peptide sequence
GLARILLRLLFRFGDSNSNSNGLVRILLRLLLRYG

SEQ ID NO: 1591 - protein, 35 aa, Artificial Sequence
  Antimicrobial peptide sequence
GLARILLRLLFRFGDSNSNSNGLAWILLRWLFFRG

SEQ ID NO: 1592 - protein, 35 aa, Artificial Sequence
  Antimicrobial peptide sequence
GLARILLRLLFRFGDSNSNSNGLVRILLRWLFFRG

SEQ ID NO: 1593 - protein, 35 aa, Artificial Sequence
  Antimicrobial peptide sequence
GLARILLRLLFRFGDSNSNSNGLLRILLRWLFFRG

SEQ ID NO: 1594 - protein, 35 aa, Artificial Sequence
  Antimicrobial peptide sequence
GLARILLRLLFRFGDSNSNSNGLPWILLRWLFRFG

SEQ ID NO: 1595 - protein, 35 aa, Artificial Sequence
  Antimicrobial peptide sequence
GLARILLRLLFRFGDSNSNSNGLLRILLRWLFRFG

SEQ ID NO: 1596 - protein, 35 aa, Artificial Sequence
  Antimicrobial peptide sequence
GLARILLRLLFRFGDSNSNSNGLPWILLRWLFRRG

SEQ ID NO: 1597 - protein, 35 aa, Artificial Sequence
  Antimicrobial peptide sequence
GLARILLRLLFRFGDNSNSNSGLPWILLRWLFFRG

SEQ ID NO: 1598 - protein, 35 aa, Artificial Sequence
  Antimicrobial peptide sequence
GLARILLRLLFRFGDNSNSNSGLARILLRWLFFRG

SEQ ID NO: 1599 - protein, 35 aa, Artificial Sequence
  Antimicrobial peptide sequence
GLARILLRLLFRFGDNSNSNSGLARILLRWLFRFG

SEQ ID NO: 1600 - protein, 35 aa, Artificial Sequence
  Antimicrobial peptide sequence
GLARILLRLLFRFGDNSNSNSGLVRILLRWLFRFG

SEQ ID NO: 1601 - protein, 35 aa, Artificial Sequence
  Antimicrobial peptide sequence
GLARILLRLLFRFGDNSNSNSGLARILLRLLFFRG

SEQ ID NO: 1602 - protein, 35 aa, Artificial Sequence
  Antimicrobial peptide sequence
GLARILLRLLFRFGDNSNSNSGLARILLRLLFRFG

SEQ ID NO: 1603 - protein, 35 aa, Artificial Sequence
  Antimicrobial peptide sequence
GLARILLRLLFRFGDNSNSNSGLVRILLRLLFRFG

SEQ ID NO: 1604 - protein, 35 aa, Artificial Sequence
  Antimicrobial peptide sequence
GLARILLRLLFRFGDNSNSNSSLVRILLRLLLRFG

SEQ ID NO: 1605 - protein, 35 aa, Artificial Sequence
  Antimicrobial peptide sequence
GLARILLRLLFRFGDNSNSNSGLVRILLRLLLRYG

SEQ ID NO: 1606 - protein, 35 aa, Artificial Sequence
  Antimicrobial peptide sequence
GLARILLRLLFRFGDNSNSNSGLAWILLRWLFFRG

SEQ ID NO: 1607 - protein, 35 aa, Artificial Sequence
  Antimicrobial peptide sequence
GLARILLRLLFRFGDNSNSNSGLVRILLRWLFFRG

SEQ ID NO: 1608 - protein, 35 aa, Artificial Sequence
  Antimicrobial peptide sequence
GLARILLRLLFRFGDNSNSNSGLLRILLRWLFFRG

SEQ ID NO: 1609 - protein, 35 aa, Artificial Sequence
  Antimicrobial peptide sequence
GLARILLRLLFRFGDNSNSNSGLPWILLRWLFRFG

SEQ ID NO: 1610 - protein, 35 aa, Artificial Sequence
  Antimicrobial peptide sequence
GLARILLRLLFRFGDNSNSNSGLLRILLRWLFRFG

SEQ ID NO: 1611 - protein, 35 aa, Artificial Sequence
  Antimicrobial peptide sequence
GLARILLRLLFRFGDNSNSNSGLPWILLRWLFRRG

SEQ ID NO: 1612 - protein, 35 aa, Artificial Sequence
  Antimicrobial peptide sequence
GLARILLRLLFRFGDHGHGHGGLPWILLRWLFFRG

SEQ ID NO: 1613 - protein, 35 aa, Artificial Sequence
  Antimicrobial peptide sequence
GLARILLRLLFRFGDHGHGHGGLARILLRWLFFRG

SEQ ID NO: 1614 - protein, 35 aa, Artificial Sequence
  Antimicrobial peptide sequence
GLARILLRLLFRFGDHGHGHGGLARILLRWLFRFG

SEQ ID NO: 1615 - protein, 35 aa, Artificial Sequence
  Antimicrobial peptide sequence
GLARILLRLLFRFGDHGHGHGGLVRILLRWLFRFG

SEQ ID NO: 1616 - protein, 35 aa, Artificial Sequence
  Antimicrobial peptide sequence
GLARILLRLLFRFGDHGHGHGGLARILLRLLFFRG

SEQ ID NO: 1617 - protein, 35 aa, Artificial Sequence
  Antimicrobial peptide sequence
GLARILLRLLFRFGDHGHGHGGLARILLRLLFRFG

SEQ ID NO: 1618 - protein, 35 aa, Artificial Sequence
  Antimicrobial peptide sequence
GLARILLRLLFRFGDHGHGHGGLVRILLRLLFRFG

SEQ ID NO: 1619 - protein, 35 aa, Artificial Sequence
  Antimicrobial peptide sequence
GLARILLRLLFRFGDHGHGHGSLVRILLRLLLRFG

SEQ ID NO: 1620 - protein, 35 aa, Artificial Sequence
  Antimicrobial peptide sequence
GLARILLRLLFRFGDHGHGHGGLVRILLRLLLRYG

SEQ ID NO: 1621 - protein, 35 aa, Artificial Sequence
  Antimicrobial peptide sequence
GLARILLRLLFRFGDHGHGHGGLAWILLRWLFFRG

SEQ ID NO: 1622 - protein, 35 aa, Artificial Sequence
  Antimicrobial peptide sequence
GLARILLRLLFRFGDHGHGHGGLVRILLRWLFFRG

SEQ ID NO: 1623 - protein, 35 aa, Artificial Sequence
  Antimicrobial peptide sequence
GLARILLRLLFRFGDHGHGHGGLLRILLRWLFFRG

SEQ ID NO: 1624 - protein, 35 aa, Artificial Sequence
  Antimicrobial peptide sequence
GLARILLRLLFRFGDHGHGHGGLPWILLRWLFRFG

SEQ ID NO: 1625 - protein, 35 aa, Artificial Sequence
  Antimicrobial peptide sequence
GLARILLRLLFRFGDHGHGHGGLLRILLRWLFRFG

SEQ ID NO: 1626 - protein, 35 aa, Artificial Sequence
  Antimicrobial peptide sequence
GLARILLRLLFRFGDHGHGHGGLPWILLRWLFRRG

SEQ ID NO: 1627 - protein, 35 aa, Artificial Sequence
  Antimicrobial peptide sequence
GLARILLRLLFRFGDGHGHGHGLPWILLRWLFFRG

SEQ ID NO: 1628 - protein, 35 aa, Artificial Sequence
  Antimicrobial peptide sequence
GLARILLRLLFRFGDGHGHGHGLARILLRWLFFRG

SEQ ID NO: 1629 - protein, 35 aa, Artificial Sequence
  Antimicrobial peptide sequence
GLARILLRLLFRFGDGHGHGHGLARILLRWLFRFG

SEQ ID NO: 1630 - protein, 35 aa, Artificial Sequence
  Antimicrobial peptide sequence
GLARILLRLLFRFGDGHGHGHGLVRILLRWLFRFG

SEQ ID NO: 1631 - protein, 35 aa, Artificial Sequence
  Antimicrobial peptide sequence
GLARILLRLLFRFGDGHGHGHGLARILLRLLFFRG

SEQ ID NO: 1632 - protein, 35 aa, Artificial Sequence
  Antimicrobial peptide sequence
GLARILLRLLFRFGDGHGHGHGLARILLRLLFRFG

SEQ ID NO: 1633 - protein, 35 aa, Artificial Sequence
  Antimicrobial peptide sequence
GLARILLRLLFRFGDGHGHGHGLVRILLRLLFRFG

SEQ ID NO: 1634 - protein, 35 aa, Artificial Sequence
  Antimicrobial peptide sequence
GLARILLRLLFRFGDGHGHGHSLVRILLRLLLRFG

SEQ ID NO: 1635 - protein, 35 aa, Artificial Sequence
  Antimicrobial peptide sequence
GLARILLRLLFRFGDGHGHGHGLVRILLRLLLRYG

SEQ ID NO: 1636 - protein, 35 aa, Artificial Sequence
  Antimicrobial peptide sequence
GLARILLRLLFRFGDGHGHGHGLAWILLRWLFFRG

SEQ ID NO: 1637 - protein, 35 aa, Artificial Sequence
  Antimicrobial peptide sequence
GLARILLRLLFRFGDGHGHGHGLVRILLRWLFFRG

SEQ ID NO: 1638 - protein, 35 aa, Artificial Sequence
  Antimicrobial peptide sequence
GLARILLRLLFRFGDGHGHGHGLLRILLRWLFFRG

SEQ ID NO: 1639 - protein, 35 aa, Artificial Sequence
  Antimicrobial peptide sequence
GLARILLRLLFRFGDGHGHGHGLPWILLRWLFRFG

SEQ ID NO: 1640 - protein, 35 aa, Artificial Sequence
  Antimicrobial peptide sequence
GLARILLRLLFRFGDGHGHGHGLLRILLRWLFRFG

SEQ ID NO: 1641 - protein, 35 aa, Artificial Sequence
  Antimicrobial peptide sequence
GLARILLRLLFRFGDGHGHGHGLPWILLRWLFRRG

SEQ ID NO: 1642 - protein, 35 aa, Artificial Sequence
  Antimicrobial peptide sequence
GLARILLRLLFRFGDHNHNHNGLPWILLRWLFFRG

SEQ ID NO: 1643 - protein, 35 aa, Artificial Sequence
  Antimicrobial peptide sequence
GLARILLRLLFRFGDHNHNHNGLARILLRWLFFRG

SEQ ID NO: 1644 - protein, 35 aa, Artificial Sequence
  Antimicrobial peptide sequence
GLARILLRLLFRFGDHNHNHNGLARILLRWLFRFG

SEQ ID NO: 1645 - protein, 35 aa, Artificial Sequence
  Antimicrobial peptide sequence
GLARILLRLLFRFGDHNHNHNGLVRILLRWLFRFG

SEQ ID NO: 1646 - protein, 35 aa, Artificial Sequence
  Antimicrobial peptide sequence
GLARILLRLLFRFGDHNHNHNGLARILLRLLFFRG

SEQ ID NO: 1647 - protein, 35 aa, Artificial Sequence
  Antimicrobial peptide sequence
GLARILLRLLFRFGDHNHNHNGLARILLRLLFRFG

SEQ ID NO: 1648 - protein, 35 aa, Artificial Sequence
  Antimicrobial peptide sequence
GLARILLRLLFRFGDHNHNHNGLVRILLRLLFRFG

SEQ ID NO: 1649 - protein, 35 aa, Artificial Sequence
  Antimicrobial peptide sequence
GLARILLRLLFRFGDHNHNHNSLVRILLRLLLRFG

SEQ ID NO: 1650 - protein, 35 aa, Artificial Sequence
  Antimicrobial peptide sequence
GLARILLRLLFRFGDHNHNHNGLVRILLRLLLRYG

SEQ ID NO: 1651 - protein, 35 aa, Artificial Sequence
  Antimicrobial peptide sequence
GLARILLRLLFRFGDHNHNHNGLAWILLRWLFFRG

SEQ ID NO: 1652 - protein, 35 aa, Artificial Sequence
  Antimicrobial peptide sequence
GLARILLRLLFRFGDHNHNHNGLVRILLRWLFFRG

SEQ ID NO: 1653 - protein, 35 aa, Artificial Sequence
  Antimicrobial peptide sequence
GLARILLRLLFRFGDHNHNHNGLLRILLRWLFFRG

SEQ ID NO: 1654 - protein, 35 aa, Artificial Sequence
  Antimicrobial peptide sequence
GLARILLRLLFRFGDHNHNHNGLPWILLRWLFRFG

SEQ ID NO: 1655 - protein, 35 aa, Artificial Sequence
  Antimicrobial peptide sequence
GLARILLRLLFRFGDHNHNHNGLLRILLRWLFRFG

SEQ ID NO: 1656 - protein, 35 aa, Artificial Sequence
  Antimicrobial peptide sequence
GLARILLRLLFRFGDHNHNHNGLPWILLRWLFRRG

SEQ ID NO: 1657 - protein, 35 aa, Artificial Sequence
  Antimicrobial peptide sequence
GLARILLRLLFRFGDNHNHNHGLPWILLRWLFFRG

SEQ ID NO: 1658 - protein, 35 aa, Artificial Sequence
  Antimicrobial peptide sequence
GLARILLRLLFRFGDNHNHNHGLARILLRWLFFRG

SEQ ID NO: 1659 - protein, 35 aa, Artificial Sequence
  Antimicrobial peptide sequence
GLARILLRLLFRFGDNHNHNHGLARILLRWLFRFG

SEQ ID NO: 1660 - protein, 35 aa, Artificial Sequence
  Antimicrobial peptide sequence
GLARILLRLLFRFGDNHNHNHGLVRILLRWLFRFG

SEQ ID NO: 1661 - protein, 35 aa, Artificial Sequence
  Antimicrobial peptide sequence
GLARILLRLLFRFGDNHNHNHGLARILLRLLFFRG

SEQ ID NO: 1662 - protein, 35 aa, Artificial Sequence
  Antimicrobial peptide sequence
GLARILLRLLFRFGDNHNHNHGLARILLRLLFRFG

SEQ ID NO: 1663 - protein, 35 aa, Artificial Sequence
  Antimicrobial peptide sequence
GLARILLRLLFRFGDNHNHNHGLVRILLRLLFRFG

SEQ ID NO: 1664 - protein, 35 aa, Artificial Sequence
  Antimicrobial peptide sequence
GLARILLRLLFRFGDNHNHNHSLVRILLRLLLRFG

SEQ ID NO: 1665 - protein, 35 aa, Artificial Sequence
  Antimicrobial peptide sequence
GLARILLRLLFRFGDNHNHNHGLVRILLRLLLRYG

SEQ ID NO: 1666 - protein, 35 aa, Artificial Sequence
  Antimicrobial peptide sequence
GLARILLRLLFRFGDNHNHNHGLAWILLRWLFFRG

SEQ ID NO: 1667 - protein, 35 aa, Artificial Sequence
  Antimicrobial peptide sequence
GLARILLRLLFRFGDNHNHNHGLVRILLRWLFFRG

SEQ ID NO: 1668 - protein, 35 aa, Artificial Sequence
  Antimicrobial peptide sequence
GLARILLRLLFRFGDNHNHNHGLLRILLRWLFFRG

SEQ ID NO: 1669 - protein, 35 aa, Artificial Sequence
  Antimicrobial peptide sequence
GLARILLRLLFRFGDNHNHNHGLPWILLRWLFRFG

SEQ ID NO: 1670 - protein, 35 aa, Artificial Sequence
  Antimicrobial peptide sequence
GLARILLRLLFRFGDNHNHNHGLLRILLRWLFRFG

SEQ ID NO: 1671 - protein, 35 aa, Artificial Sequence
  Antimicrobial peptide sequence
GLARILLRLLFRFGDNHNHNHGLPWILLRWLFRRG

SEQ ID NO: 1672 - protein, 33 aa, Artificial Sequence
  Antimicrobial peptide sequence
GLVRILLRLLFRFGDGGGGGLPWILLRWLFFRG

SEQ ID NO: 1673 - protein, 33 aa, Artificial Sequence
  Antimicrobial peptide sequence
GLVRILLRLLFRFGDGGGGGLARILLRWLFFRG

SEQ ID NO: 1674 - protein, 33 aa, Artificial Sequence
  Antimicrobial peptide sequence
GLVRILLRLLFRFGDGGGGGLARILLRWLFRFG

SEQ ID NO: 1675 - protein, 33 aa, Artificial Sequence
  Antimicrobial peptide sequence
GLVRILLRLLFRFGDGGGGGLVRILLRWLFRFG

SEQ ID NO: 1676 - protein, 33 aa, Artificial Sequence
  Antimicrobial peptide sequence
GLVRILLRLLFRFGDGGGGGLARILLRLLFFRG

SEQ ID NO: 1677 - protein, 33 aa, Artificial Sequence
  Antimicrobial peptide sequence
GLVRILLRLLFRFGDGGGGGLARILLRLLFRFG

SEQ ID NO: 1678 - protein, 33 aa, Artificial Sequence
  Antimicrobial peptide sequence
GLVRILLRLLFRFGDGGGGGLVRILLRLLFRFG

SEQ ID NO: 1679 - protein, 33 aa, Artificial Sequence
  Antimicrobial peptide sequence
GLVRILLRLLFRFGDGGGGSLVRILLRLLLRFG

SEQ ID NO: 1680 - protein, 33 aa, Artificial Sequence
  Antimicrobial peptide sequence
GLVRILLRLLFRFGDGGGGGLVRILLRLLLRYG

SEQ ID NO: 1681 - protein, 33 aa, Artificial Sequence
  Antimicrobial peptide sequence
GLVRILLRLLFRFGDGGGGGLAWILLRWLFFRG

SEQ ID NO: 1682 - protein, 33 aa, Artificial Sequence
  Antimicrobial peptide sequence
GLVRILLRLLFRFGDGGGGGLVRILLRWLFFRG

SEQ ID NO: 1683 - protein, 33 aa, Artificial Sequence
  Antimicrobial peptide sequence
GLVRILLRLLFRFGDGGGGGLLRILLRWLFFRG

SEQ ID NO: 1684 - protein, 33 aa, Artificial Sequence
  Antimicrobial peptide sequence
GLVRILLRLLFRFGDGGGGGLPWILLRWLFRFG

SEQ ID NO: 1685 - protein, 33 aa, Artificial Sequence
  Antimicrobial peptide sequence
GLVRILLRLLFRFGDGGGGGLLRILLRWLFRFG

SEQ ID NO: 1686 - protein, 33 aa, Artificial Sequence
  Antimicrobial peptide sequence
GLVRILLRLLFRFGDGGGGGLPWILLRWLFRRG

SEQ ID NO: 1687 - protein, 34 aa, Artificial Sequence
  Antimicrobial peptide sequence
GLVRILLRLLFRFGDGGGGGGLPWILLRWLFFRG

SEQ ID NO: 1688 - protein, 34 aa, Artificial Sequence
  Antimicrobial peptide sequence
GLVRILLRLLFRFGDGGGGGGLARILLRWLFFRG

SEQ ID NO: 1689 - protein, 34 aa, Artificial Sequence
  Antimicrobial peptide sequence
GLVRILLRLLFRFGDGGGGGGLARILLRWLFRFG

SEQ ID NO: 1690 - protein, 34 aa, Artificial Sequence
  Antimicrobial peptide sequence
GLVRILLRLLFRFGDGGGGGGLVRILLRWLFRFG

SEQ ID NO: 1691 - protein, 34 aa, Artificial Sequence
  Antimicrobial peptide sequence
GLVRILLRLLFRFGDGGGGGGLARILLRLLFFRG

SEQ ID NO: 1692 - protein, 34 aa, Artificial Sequence
  Antimicrobial peptide sequence
GLVRILLRLLFRFGDGGGGGGLARILLRLLFRFG

SEQ ID NO: 1693 - protein, 34 aa, Artificial Sequence
  Antimicrobial peptide sequence
GLVRILLRLLFRFGDGGGGGGLVRILLRLLFRFG

SEQ ID NO: 1694 - protein, 34 aa, Artificial Sequence
  Antimicrobial peptide sequence
GLVRILLRLLFRFGDGGGGGSLVRILLRLLLRFG

SEQ ID NO: 1695 - protein, 34 aa, Artificial Sequence
  Antimicrobial peptide sequence
GLVRILLRLLFRFGDGGGGGGLVRILLRLLLRYG

SEQ ID NO: 1696 - protein, 34 aa, Artificial Sequence
  Antimicrobial peptide sequence
GLVRILLRLLFRFGDGGGGGGLAWILLRWLFFRG

SEQ ID NO: 1697 - protein, 34 aa, Artificial Sequence
  Antimicrobial peptide sequence
GLVRILLRLLFRFGDGGGGGGLVRILLRWLFFRG

SEQ ID NO: 1698 - protein, 34 aa, Artificial Sequence
  Antimicrobial peptide sequence
GLVRILLRLLFRFGDGGGGGGLLRILLRWLFFRG

SEQ ID NO: 1699 - protein, 34 aa, Artificial Sequence
  Antimicrobial peptide sequence
GLVRILLRLLFRFGDGGGGGGLPWILLRWLFRFG

SEQ ID NO: 1700 - protein, 34 aa, Artificial Sequence
  Antimicrobial peptide sequence
GLVRILLRLLFRFGDGGGGGGLLRILLRWLFRFG

SEQ ID NO: 1701 - protein, 34 aa, Artificial Sequence
  Antimicrobial peptide sequence
GLVRILLRLLFRFGDGGGGGGLPWILLRWLFRRG

SEQ ID NO: 1702 - protein, 35 aa, Artificial Sequence
  Antimicrobial peptide sequence
GLVRILLRLLFRFGDGGGGGGGLPWILLRWLFFRG

SEQ ID NO: 1703 - protein, 35 aa, Artificial Sequence
  Antimicrobial peptide sequence
GLVRILLRLLFRFGDGGGGGGGLARILLRWLFFRG

SEQ ID NO: 1704 - protein, 35 aa, Artificial Sequence
  Antimicrobial peptide sequence
GLVRILLRLLFRFGDGGGGGGGLARILLRWLFRFG

SEQ ID NO: 1705 - protein, 35 aa, Artificial Sequence
  Antimicrobial peptide sequence
GLVRILLRLLFRFGDGGGGGGGLVRILLRWLFRFG

SEQ ID NO: 1706 - protein, 35 aa, Artificial Sequence
  Antimicrobial peptide sequence
GLVRILLRLLFRFGDGGGGGGGLARILLRLLFFRG

SEQ ID NO: 1707 - protein, 35 aa, Artificial Sequence
  Antimicrobial peptide sequence
GLVRILLRLLFRFGDGGGGGGGLARILLRLLFRFG

SEQ ID NO: 1708 - protein, 35 aa, Artificial Sequence
  Antimicrobial peptide sequence
GLVRILLRLLFRFGDGGGGGGGLVRILLRLLFRFG

SEQ ID NO: 1709 - protein, 35 aa, Artificial Sequence
  Antimicrobial peptide sequence
GLVRILLRLLFRFGDGGGGGGSLVRILLRLLLRFG

SEQ ID NO: 1710 - protein, 35 aa, Artificial Sequence
  Antimicrobial peptide sequence
GLVRILLRLLFRFGDGGGGGGGLVRILLRLLLRYG

SEQ ID NO: 1711 - protein, 35 aa, Artificial Sequence
  Antimicrobial peptide sequence
GLVRILLRLLFRFGDGGGGGGGLAWILLRWLFFRG

SEQ ID NO: 1712 - protein, 35 aa, Artificial Sequence
  Antimicrobial peptide sequence
GLVRILLRLLFRFGDGGGGGGGLVRILLRWLFFRG

SEQ ID NO: 1713 - protein, 35 aa, Artificial Sequence
  Antimicrobial peptide sequence
GLVRILLRLLFRFGDGGGGGGGLLRILLRWLFFRG

SEQ ID NO: 1714 - protein, 35 aa, Artificial Sequence
  Antimicrobial peptide sequence
GLVRILLRLLFRFGDGGGGGGGLPWILLRWLFRFG

SEQ ID NO: 1715 - protein, 35 aa, Artificial Sequence
  Antimicrobial peptide sequence
GLVRILLRLLFRFGDGGGGGGGLLRILLRWLFRFG

SEQ ID NO: 1716 - protein, 35 aa, Artificial Sequence
  Antimicrobial peptide sequence
GLVRILLRLLFRFGDGGGGGGGLPWILLRWLFRRG

SEQ ID NO: 1717 - protein, 36 aa, Artificial Sequence
  Antimicrobial peptide sequence
GLVRILLRLLFRFGDGGGGGGGGLPWILLRWLFFRG

SEQ ID NO: 1718 - protein, 36 aa, Artificial Sequence
  Antimicrobial peptide sequence
GLVRILLRLLFRFGDGGGGGGGGLARILLRWLFFRG

SEQ ID NO: 1719 - protein, 36 aa, Artificial Sequence
  Antimicrobial peptide sequence
GLVRILLRLLFRFGDGGGGGGGGLARILLRWLFRFG

SEQ ID NO: 1720 - protein, 36 aa, Artificial Sequence
  Antimicrobial peptide sequence
GLVRILLRLLFRFGDGGGGGGGGLVRILLRWLFRFG

SEQ ID NO: 1721 - protein, 36 aa, Artificial Sequence
  Antimicrobial peptide sequence
GLVRILLRLLFRFGDGGGGGGGGLARILLRLLFFRG

SEQ ID NO: 1722 - protein, 36 aa, Artificial Sequence
  Antimicrobial peptide sequence
GLVRILLRLLFRFGDGGGGGGGGLARILLRLLFRFG

SEQ ID NO: 1723 - protein, 36 aa, Artificial Sequence
  Antimicrobial peptide sequence
GLVRILLRLLFRFGDGGGGGGGGLVRILLRLLFRFG

SEQ ID NO: 1724 - protein, 36 aa, Artificial Sequence
  Antimicrobial peptide sequence
GLVRILLRLLFRFGDGGGGGGGSLVRILLRLLLRFG

SEQ ID NO: 1725 - protein, 36 aa, Artificial Sequence
  Antimicrobial peptide sequence
GLVRILLRLLFRFGDGGGGGGGGLVRILLRLLLRYG

SEQ ID NO: 1726 - protein, 36 aa, Artificial Sequence
  Antimicrobial peptide sequence
GLVRILLRLLFRFGDGGGGGGGGLAWILLRWLFFRG

SEQ ID NO: 1727 - protein, 36 aa, Artificial Sequence
  Antimicrobial peptide sequence
GLVRILLRLLFRFGDGGGGGGGGLVRILLRWLFFRG

SEQ ID NO: 1728 - protein, 36 aa, Artificial Sequence
  Antimicrobial peptide sequence
GLVRILLRLLFRFGDGGGGGGGGLLRILLRWLFFRG

SEQ ID NO: 1729 - protein, 36 aa, Artificial Sequence
  Antimicrobial peptide sequence
GLVRILLRLLFRFGDGGGGGGGGLPWILLRWLFRFG

SEQ ID NO: 1730 - protein, 36 aa, Artificial Sequence
  Antimicrobial peptide sequence
GLVRILLRLLFRFGDGGGGGGGGLLRILLRWLFRFG

SEQ ID NO: 1731 - protein, 36 aa, Artificial Sequence
  Antimicrobial peptide sequence
GLVRILLRLLFRFGDGGGGGGGGLPWILLRWLFRRG

SEQ ID NO: 1732 - protein, 33 aa, Artificial Sequence
  Antimicrobial peptide sequence
GLVRILLRLLFRFGDNNNNGLPWILLRWLFFRG

SEQ ID NO: 1733 - protein, 33 aa, Artificial Sequence
  Antimicrobial peptide sequence
GLVRILLRLLFRFGDNNNNGLARILLRWLFFRG

SEQ ID NO: 1734 - protein, 33 aa, Artificial Sequence
  Antimicrobial peptide sequence
GLVRILLRLLFRFGDNNNNGLARILLRWLFRFG

SEQ ID NO: 1735 - protein, 33 aa, Artificial Sequence
  Antimicrobial peptide sequence
GLVRILLRLLFRFGDNNNNGLVRILLRWLFRFG

SEQ ID NO: 1736 - protein, 33 aa, Artificial Sequence
  Antimicrobial peptide sequence
GLVRILLRLLFRFGDNNNNGLARILLRLLFFRG

SEQ ID NO: 1737 - protein, 33 aa, Artificial Sequence
  Antimicrobial peptide sequence
GLVRILLRLLFRFGDNNNNGLARILLRLLFRFG

SEQ ID NO: 1738 - protein, 33 aa, Artificial Sequence
  Antimicrobial peptide sequence
GLVRILLRLLFRFGDNNNNGLVRILLRLLFRFG

SEQ ID NO: 1739 - protein, 33 aa, Artificial Sequence
  Antimicrobial peptide sequence
GLVRILLRLLFRFGDNNNNSLVRILLRLLLRFG

SEQ ID NO: 1740 - protein, 33 aa, Artificial Sequence
  Antimicrobial peptide sequence
GLVRILLRLLFRFGDNNNNGLVRILLRLLLRYG

SEQ ID NO: 1741 - protein, 33 aa, Artificial Sequence
  Antimicrobial peptide sequence
GLVRILLRLLFRFGDNNNNGLAWILLRWLFFRG

SEQ ID NO: 1742 - protein, 33 aa, Artificial Sequence
  Antimicrobial peptide sequence
GLVRILLRLLFRFGDNNNNGLVRILLRWLFFRG

SEQ ID NO: 1743 - protein, 33 aa, Artificial Sequence
  Antimicrobial peptide sequence
GLVRILLRLLFRFGDNNNNGLLRILLRWLFFRG

SEQ ID NO: 1744 - protein, 33 aa, Artificial Sequence
  Antimicrobial peptide sequence
GLVRILLRLLFRFGDNNNNGLPWILLRWLFRFG

SEQ ID NO: 1745 - protein, 33 aa, Artificial Sequence
  Antimicrobial peptide sequence
GLVRILLRLLFRFGDNNNNGLLRILLRWLFRFG

SEQ ID NO: 1746 - protein, 33 aa, Artificial Sequence
  Antimicrobial peptide sequence
GLVRILLRLLFRFGDNNNNGLPWILLRWLFRRG

SEQ ID NO: 1747 - protein, 34 aa, Artificial Sequence
  Antimicrobial peptide sequence
GLVRILLRLLFRFGDNNNNNGLPWILLRWLFFRG

SEQ ID NO: 1748 - protein, 34 aa, Artificial Sequence
  Antimicrobial peptide sequence
GLVRILLRLLFRFGDNNNNNGLARILLRWLFFRG

SEQ ID NO: 1749 - protein, 34 aa, Artificial Sequence
  Antimicrobial peptide sequence
GLVRILLRLLFRFGDNNNNNGLARILLRWLFRFG

SEQ ID NO: 1750 - protein, 34 aa, Artificial Sequence
  Antimicrobial peptide sequence
GLVRILLRLLFRFGDNNNNNGLVRILLRWLFRFG

SEQ ID NO: 1751 - protein, 34 aa, Artificial Sequence
  Antimicrobial peptide sequence
GLVRILLRLLFRFGDNNNNNGLARILLRLLFFRG

SEQ ID NO: 1752 - protein, 34 aa, Artificial Sequence
  Antimicrobial peptide sequence
GLVRILLRLLFRFGDNNNNNGLARILLRLLFRFG

SEQ ID NO: 1753 - protein, 34 aa, Artificial Sequence
  Antimicrobial peptide sequence
GLVRILLRLLFRFGDNNNNNGLVRILLRLLFRFG

SEQ ID NO: 1754 - protein, 34 aa, Artificial Sequence
  Antimicrobial peptide sequence
GLVRILLRLLFRFGDNNNNNSLVRILLRLLLRFG

SEQ ID NO: 1755 - protein, 34 aa, Artificial Sequence
  Antimicrobial peptide sequence
GLVRILLRLLFRFGDNNNNNGLVRILLRLLLRYG

SEQ ID NO: 1756 - protein, 34 aa, Artificial Sequence
  Antimicrobial peptide sequence
GLVRILLRLLFRFGDNNNNNGLAWILLRWLFFRG

SEQ ID NO: 1757 - protein, 34 aa, Artificial Sequence
  Antimicrobial peptide sequence
GLVRILLRLLFRFGDNNNNNGLVRILLRWLFFRG

SEQ ID NO: 1758 - protein, 34 aa, Artificial Sequence
  Antimicrobial peptide sequence
GLVRILLRLLFRFGDNNNNNGLLRILLRWLFFRG

SEQ ID NO: 1759 - protein, 34 aa, Artificial Sequence
  Antimicrobial peptide sequence
GLVRILLRLLFRFGDNNNNNGLPWILLRWLFRFG

SEQ ID NO: 1760 - protein, 34 aa, Artificial Sequence
  Antimicrobial peptide sequence
GLVRILLRLLFRFGDNNNNNGLLRILLRWLFRFG

SEQ ID NO: 1761 - protein, 34 aa, Artificial Sequence
  Antimicrobial peptide sequence
GLVRILLRLLFRFGDNNNNNGLPWILLRWLFRRG

SEQ ID NO: 1762 - protein, 35 aa, Artificial Sequence
  Antimicrobial peptide sequence
GLVRILLRLLFRFGDNNNNNNGLPWILLRWLFFRG

SEQ ID NO: 1763 - protein, 35 aa, Artificial Sequence
  Antimicrobial peptide sequence
GLVRILLRLLFRFGDNNNNNNGLARILLRWLFFRG

SEQ ID NO: 1764 - protein, 35 aa, Artificial Sequence
  Antimicrobial peptide sequence
GLVRILLRLLFRFGDNNNNNNGLARILLRWLFRFG

SEQ ID NO: 1765 - protein, 35 aa, Artificial Sequence
  Antimicrobial peptide sequence
GLVRILLRLLFRFGDNNNNNNGLVRILLRWLFRFG

SEQ ID NO: 1766 - protein, 35 aa, Artificial Sequence
  Antimicrobial peptide sequence
GLVRILLRLLFRFGDNNNNNNGLARILLRLLFFRG

SEQ ID NO: 1767 - protein, 35 aa, Artificial Sequence
  Antimicrobial peptide sequence
GLVRILLRLLFRFGDNNNNNNGLARILLRLLFRFG

SEQ ID NO: 1768 - protein, 35 aa, Artificial Sequence
  Antimicrobial peptide sequence
GLVRILLRLLFRFGDNNNNNNGLVRILLRLLFRFG

SEQ ID NO: 1769 - protein, 35 aa, Artificial Sequence
  Antimicrobial peptide sequence
GLVRILLRLLFRFGDNNNNNNSLVRILLRLLLRFG

SEQ ID NO: 1770 - protein, 35 aa, Artificial Sequence
  Antimicrobial peptide sequence
GLVRILLRLLFRFGDNNNNNNGLVRILLRLLLRYG

SEQ ID NO: 1771 - protein, 35 aa, Artificial Sequence
  Antimicrobial peptide sequence
GLVRILLRLLFRFGDNNNNNNGLAWILLRWLFFRG

SEQ ID NO: 1772 - protein, 35 aa, Artificial Sequence
  Antimicrobial peptide sequence
GLVRILLRLLFRFGDNNNNNNGLVRILLRWLFFRG

SEQ ID NO: 1773 - protein, 35 aa, Artificial Sequence
  Antimicrobial peptide sequence
GLVRILLRLLFRFGDNNNNNNGLLRILLRWLFFRG

SEQ ID NO: 1774 - protein, 35 aa, Artificial Sequence
  Antimicrobial peptide sequence
GLVRILLRLLFRFGDNNNNNNGLPWILLRWLFRFG

SEQ ID NO: 1775 - protein, 35 aa, Artificial Sequence
  Antimicrobial peptide sequence
GLVRILLRLLFRFGDNNNNNNGLLRILLRWLFRFG

SEQ ID NO: 1776 - protein, 35 aa, Artificial Sequence
  Antimicrobial peptide sequence
GLVRILLRLLFRFGDNNNNNNGLPWILLRWLFRRG

SEQ ID NO: 1777 - protein, 36 aa, Artificial Sequence
  Antimicrobial peptide sequence
GLVRILLRLLFRFGDNNNNNNNGLPWILLRWLFFRG

SEQ ID NO: 1778 - protein, 36 aa, Artificial Sequence
  Antimicrobial peptide sequence
GLVRILLRLLFRFGDNNNNNNNGLARILLRWLFFRG

SEQ ID NO: 1779 - protein, 36 aa, Artificial Sequence
  Antimicrobial peptide sequence
GLVRILLRLLFRFGDNNNNNNNGLARILLRWLFRFG

SEQ ID NO: 1780 - protein, 36 aa, Artificial Sequence
  Antimicrobial peptide sequence
GLVRILLRLLFRFGDNNNNNNNGLVRILLRWLFRFG

SEQ ID NO: 1781 - protein, 36 aa, Artificial Sequence
  Antimicrobial peptide sequence
GLVRILLRLLFRFGDNNNNNNNGLARILLRLLFFRG

SEQ ID NO: 1782 - protein, 36 aa, Artificial Sequence
  Antimicrobial peptide sequence
GLVRILLRLLFRFGDNNNNNNNGLARILLRLLFRFG

SEQ ID NO: 1783 - protein, 36 aa, Artificial Sequence
  Antimicrobial peptide sequence
GLVRILLRLLFRFGDNNNNNNNGLVRILLRLLFRFG

SEQ ID NO: 1784 - protein, 36 aa, Artificial Sequence
  Antimicrobial peptide sequence
GLVRILLRLLFRFGDNNNNNNNSLVRILLRLLLRFG

SEQ ID NO: 1785 - protein, 36 aa, Artificial Sequence
  Antimicrobial peptide sequence
GLVRILLRLLFRFGDNNNNNNNGLVRILLRLLLRYG

SEQ ID NO: 1786 - protein, 36 aa, Artificial Sequence
  Antimicrobial peptide sequence
GLVRILLRLLFRFGDNNNNNNNGLAWILLRWLFFRG

SEQ ID NO: 1787 - protein, 36 aa, Artificial Sequence
  Antimicrobial peptide sequence
GLVRILLRLLFRFGDNNNNNNNGLVRILLRWLFFRG

SEQ ID NO: 1788 - protein, 36 aa, Artificial Sequence
  Antimicrobial peptide sequence
GLVRILLRLLFRFGDNNNNNNNGLLRILLRWLFFRG

SEQ ID NO: 1789 - protein, 36 aa, Artificial Sequence
  Antimicrobial peptide sequence
GLVRILLRLLFRFGDNNNNNNNGLPWILLRWLFRFG

SEQ ID NO: 1790 - protein, 36 aa, Artificial Sequence
  Antimicrobial peptide sequence
GLVRILLRLLFRFGDNNNNNNNGLLRILLRWLFRFG

SEQ ID NO: 1791 - protein, 36 aa, Artificial Sequence
  Antimicrobial peptide sequence
GLVRILLRLLFRFGDNNNNNNNGLPWILLRWLFRRG

SEQ ID NO: 1792 - protein, 35 aa, Artificial Sequence
  Antimicrobial peptide sequence
GLVRILLRLLFRFGDNGNGNGGLPWILLRWLFFRG

SEQ ID NO: 1793 - protein, 35 aa, Artificial Sequence
  Antimicrobial peptide sequence
GLVRILLRLLFRFGDNGNGNGGLARILLRWLFFRG

SEQ ID NO: 1794 - protein, 35 aa, Artificial Sequence
  Antimicrobial peptide sequence
GLVRILLRLLFRFGDNGNGNGGLARILLRWLFRFG

SEQ ID NO: 1795 - protein, 35 aa, Artificial Sequence
  Antimicrobial peptide sequence
GLVRILLRLLFRFGDNGNGNGGLVRILLRWLFRFG

SEQ ID NO: 1796 - protein, 35 aa, Artificial Sequence
  Antimicrobial peptide sequence
GLVRILLRLLFRFGDNGNGNGGLARILLRLLFFRG

SEQ ID NO: 1797 - protein, 35 aa, Artificial Sequence
  Antimicrobial peptide sequence
GLVRILLRLLFRFGDNGNGNGGLARILLRLLFRFG

SEQ ID NO: 1798 - protein, 35 aa, Artificial Sequence
  Antimicrobial peptide sequence
GLVRILLRLLFRFGDNGNGNGGLVRILLRLLFRFG

SEQ ID NO: 1799 - protein, 35 aa, Artificial Sequence
  Antimicrobial peptide sequence
GLVRILLRLLFRFGDNGNGNGSLVRILLRLLLRFG

SEQ ID NO: 1800 - protein, 35 aa, Artificial Sequence
  Antimicrobial peptide sequence
GLVRILLRLLFRFGDNGNGNGGLVRILLRLLLRYG

SEQ ID NO: 1801 - protein, 35 aa, Artificial Sequence
  Antimicrobial peptide sequence
GLVRILLRLLFRFGDNGNGNGGLAWILLRWLFFRG

SEQ ID NO: 1802 - protein, 35 aa, Artificial Sequence
  Antimicrobial peptide sequence
GLVRILLRLLFRFGDNGNGNGGLVRILLRWLFFRG

SEQ ID NO: 1803 - protein, 35 aa, Artificial Sequence
  Antimicrobial peptide sequence
GLVRILLRLLFRFGDNGNGNGGLLRILLRWLFFRG

SEQ ID NO: 1804 - protein, 35 aa, Artificial Sequence
  Antimicrobial peptide sequence
GLVRILLRLLFRFGDNGNGNGGLPWILLRWLFRFG

SEQ ID NO: 1805 - protein, 35 aa, Artificial Sequence
  Antimicrobial peptide sequence
GLVRILLRLLFRFGDNGNGNGGLLRILLRWLFRFG

SEQ ID NO: 1806 - protein, 35 aa, Artificial Sequence
  Antimicrobial peptide sequence
GLVRILLRLLFRFGDNGNGNGGLPWILLRWLFRRG

SEQ ID NO: 1807 - protein, 35 aa, Artificial Sequence
  Antimicrobial peptide sequence
GLVRILLRLLFRFGDGNGNGNGLPWILLRWLFFRG

SEQ ID NO: 1808 - protein, 35 aa, Artificial Sequence
  Antimicrobial peptide sequence
GLVRILLRLLFRFGDGNGNGNGLARILLRWLFFRG

SEQ ID NO: 1809 - protein, 35 aa, Artificial Sequence
  Antimicrobial peptide sequence
GLVRILLRLLFRFGDGNGNGNGLARILLRWLFRFG

SEQ ID NO: 1810 - protein, 35 aa, Artificial Sequence
  Antimicrobial peptide sequence
GLVRILLRLLFRFGDGNGNGNGLVRILLRWLFRFG

SEQ ID NO: 1811 - protein, 35 aa, Artificial Sequence
  Antimicrobial peptide sequence
GLVRILLRLLFRFGDGNGNGNGLARILLRLLFFRG

SEQ ID NO: 1812 - protein, 35 aa, Artificial Sequence
  Antimicrobial peptide sequence
GLVRILLRLLFRFGDGNGNGNGLARILLRLLFRFG

SEQ ID NO: 1813 - protein, 35 aa, Artificial Sequence
  Antimicrobial peptide sequence
GLVRILLRLLFRFGDGNGNGNGLVRILLRLLFRFG

SEQ ID NO: 1814 - protein, 35 aa, Artificial Sequence
  Antimicrobial peptide sequence
GLVRILLRLLFRFGDGNGNGNSLVRILLRLLLRFG

SEQ ID NO: 1815 - protein, 35 aa, Artificial Sequence
  Antimicrobial peptide sequence
GLVRILLRLLFRFGDGNGNGNGLVRILLRLLLRYG

SEQ ID NO: 1816 - protein, 35 aa, Artificial Sequence
  Antimicrobial peptide sequence
GLVRILLRLLFRFGDGNGNGNGLAWILLRWLFFRG

SEQ ID NO: 1817 - protein, 35 aa, Artificial Sequence
  Antimicrobial peptide sequence
GLVRILLRLLFRFGDGNGNGNGLVRILLRWLFFRG

SEQ ID NO: 1818 - protein, 35 aa, Artificial Sequence
  Antimicrobial peptide sequence
GLVRILLRLLFRFGDGNGNGNGLLRILLRWLFFRG

SEQ ID NO: 1819 - protein, 35 aa, Artificial Sequence
  Antimicrobial peptide sequence
GLVRILLRLLFRFGDGNGNGNGLPWILLRWLFRFG

SEQ ID NO: 1820 - protein, 35 aa, Artificial Sequence
  Antimicrobial peptide sequence
GLVRILLRLLFRFGDGNGNGNGLLRILLRWLFRFG

SEQ ID NO: 1821 - protein, 35 aa, Artificial Sequence
  Antimicrobial peptide sequence
GLVRILLRLLFRFGDGNGNGNGLPWILLRWLFRRG

SEQ ID NO: 1822 - protein, 35 aa, Artificial Sequence
  Antimicrobial peptide sequence
GLVRILLRLLFRFGDSGSGSGGLPWILLRWLFFRG

SEQ ID NO: 1823 - protein, 35 aa, Artificial Sequence
  Antimicrobial peptide sequence
GLVRILLRLLFRFGDSGSGSGGLARILLRWLFFRG

SEQ ID NO: 1824 - protein, 35 aa, Artificial Sequence
  Antimicrobial peptide sequence
GLVRILLRLLFRFGDSGSGSGGLARILLRWLFRFG

SEQ ID NO: 1825 - protein, 35 aa, Artificial Sequence
  Antimicrobial peptide sequence
GLVRILLRLLFRFGDSGSGSGGLVRILLRWLFRFG

SEQ ID NO: 1826 - protein, 35 aa, Artificial Sequence
  Antimicrobial peptide sequence
GLVRILLRLLFRFGDSGSGSGGLARILLRLLFFRG

SEQ ID NO: 1827 - protein, 35 aa, Artificial Sequence
  Antimicrobial peptide sequence
GLVRILLRLLFRFGDSGSGSGGLARILLRLLFRFG

SEQ ID NO: 1828 - protein, 35 aa, Artificial Sequence
  Antimicrobial peptide sequence
GLVRILLRLLFRFGDSGSGSGGLVRILLRLLFRFG

SEQ ID NO: 1829 - protein, 35 aa, Artificial Sequence
  Antimicrobial peptide sequence
GLVRILLRLLFRFGDSGSGSGSLVRILLRLLLRFG

SEQ ID NO: 1830 - protein, 35 aa, Artificial Sequence
  Antimicrobial peptide sequence
GLVRILLRLLFRFGDSGSGSGGLVRILLRLLLRYG

SEQ ID NO: 1831 - protein, 35 aa, Artificial Sequence
  Antimicrobial peptide sequence
GLVRILLRLLFRFGDSGSGSGGLAWILLRWLFFRG

SEQ ID NO: 1832 - protein, 35 aa, Artificial Sequence
  Antimicrobial peptide sequence
GLVRILLRLLFRFGDSGSGSGGLVRILLRWLFFRG

SEQ ID NO: 1833 - protein, 35 aa, Artificial Sequence
  Antimicrobial peptide sequence
GLVRILLRLLFRFGDSGSGSGGLLRILLRWLFFRG

SEQ ID NO: 1834 - protein, 35 aa, Artificial Sequence
  Antimicrobial peptide sequence
GLVRILLRLLFRFGDSGSGSGGLPWILLRWLFRFG

SEQ ID NO: 1835 - protein, 35 aa, Artificial Sequence
  Antimicrobial peptide sequence
GLVRILLRLLFRFGDSGSGSGGLLRILLRWLFRFG

SEQ ID NO: 1836 - protein, 35 aa, Artificial Sequence
  Antimicrobial peptide sequence
GLVRILLRLLFRFGDSGSGSGGLPWILLRWLFRRG

SEQ ID NO: 1837 - protein, 35 aa, Artificial Sequence
  Antimicrobial peptide sequence
GLVRILLRLLFRFGDGSGSGSGLPWILLRWLFFRG

SEQ ID NO: 1838 - protein, 35 aa, Artificial Sequence
  Antimicrobial peptide sequence
GLVRILLRLLFRFGDGSGSGSGLARILLRWLFFRG

SEQ ID NO: 1839 - protein, 35 aa, Artificial Sequence
  Antimicrobial peptide sequence
GLVRILLRLLFRFGDGSGSGSGLARILLRWLFRFG

SEQ ID NO: 1840 - protein, 35 aa, Artificial Sequence
  Antimicrobial peptide sequence
GLVRILLRLLFRFGDGSGSGSGLVRILLRWLFRFG

SEQ ID NO: 1841 - protein, 35 aa, Artificial Sequence
  Antimicrobial peptide sequence
GLVRILLRLLFRFGDGSGSGSGLARILLRLLFFRG

SEQ ID NO: 1842 - protein, 35 aa, Artificial Sequence
  Antimicrobial peptide sequence
GLVRILLRLLFRFGDGSGSGSGLARILLRLLFRFG

SEQ ID NO: 1843 - protein, 35 aa, Artificial Sequence
  Antimicrobial peptide sequence
GLVRILLRLLFRFGDGSGSGSGLVRILLRLLFRFG

SEQ ID NO: 1844 - protein, 35 aa, Artificial Sequence
  Antimicrobial peptide sequence
GLVRILLRLLFRFGDGSGSGSSLVRILLRLLLRFG

SEQ ID NO: 1845 - protein, 35 aa, Artificial Sequence
  Antimicrobial peptide sequence
GLVRILLRLLFRFGDGSGSGSGLVRILLRLLLRYG

SEQ ID NO: 1846 - protein, 35 aa, Artificial Sequence
  Antimicrobial peptide sequence
GLVRILLRLLFRFGDGSGSGSGLAWILLRWLFFRG

SEQ ID NO: 1847 - protein, 35 aa, Artificial Sequence
  Antimicrobial peptide sequence
GLVRILLRLLFRFGDGSGSGSGLVRILLRWLFFRG

SEQ ID NO: 1848 - protein, 35 aa, Artificial Sequence
  Antimicrobial peptide sequence
GLVRILLRLLFRFGDGSGSGSGLLRILLRWLFFRG

SEQ ID NO: 1849 - protein, 35 aa, Artificial Sequence
  Antimicrobial peptide sequence
GLVRILLRLLFRFGDGSGSGSGLPWILLRWLFRFG

SEQ ID NO: 1850 - protein, 35 aa, Artificial Sequence
  Antimicrobial peptide sequence
GLVRILLRLLFRFGDGSGSGSGLLRILLRWLFRFG

SEQ ID NO: 1851 - protein, 35 aa, Artificial Sequence
  Antimicrobial peptide sequence
GLVRILLRLLFRFGDGSGSGSGLPWILLRWLFRRG

SEQ ID NO: 1852 - protein, 35 aa, Artificial Sequence
  Antimicrobial peptide sequence
GLVRILLRLLFRFGDSNSNSNGLPWILLRWLFFRG

SEQ ID NO: 1853 - protein, 35 aa, Artificial Sequence
  Antimicrobial peptide sequence
GLVRILLRLLFRFGDSNSNSNGLARILLRWLFFRG

SEQ ID NO: 1854 - protein, 35 aa, Artificial Sequence
  Antimicrobial peptide sequence
GLVRILLRLLFRFGDSNSNSNGLARILLRWLFRFG

SEQ ID NO: 1855 - protein, 35 aa, Artificial Sequence
  Antimicrobial peptide sequence
GLVRILLRLLFRFGDSNSNSNGLVRILLRWLFRFG

SEQ ID NO: 1856 - protein, 35 aa, Artificial Sequence
  Antimicrobial peptide sequence
GLVRILLRLLFRFGDSNSNSNGLARILLRLLFFRG

SEQ ID NO: 1857 - protein, 35 aa, Artificial Sequence
  Antimicrobial peptide sequence
GLVRILLRLLFRFGDSNSNSNGLARILLRLLFRFG

SEQ ID NO: 1858 - protein, 35 aa, Artificial Sequence
  Antimicrobial peptide sequence
GLVRILLRLLFRFGDSNSNSNGLVRILLRLLFRFG

SEQ ID NO: 1859 - protein, 35 aa, Artificial Sequence
  Antimicrobial peptide sequence
GLVRILLRLLFRFGDSNSNSNSLVRILLRLLLRFG

SEQ ID NO: 1860 - protein, 35 aa, Artificial Sequence
  Antimicrobial peptide sequence
GLVRILLRLLFRFGDSNSNSNGLVRILLRLLLRYG

SEQ ID NO: 1861 - protein, 35 aa, Artificial Sequence
  Antimicrobial peptide sequence
GLVRILLRLLFRFGDSNSNSNGLAWILLRWLFFRG

SEQ ID NO: 1862 - protein, 35 aa, Artificial Sequence
  Antimicrobial peptide sequence
GLVRILLRLLFRFGDSNSNSNGLVRILLRWLFFRG

SEQ ID NO: 1863 - protein, 35 aa, Artificial Sequence
  Antimicrobial peptide sequence
GLVRILLRLLFRFGDSNSNSNGLLRILLRWLFFRG

SEQ ID NO: 1864 - protein, 35 aa, Artificial Sequence
  Antimicrobial peptide sequence
GLVRILLRLLFRFGDSNSNSNGLPWILLRWLFRFG

SEQ ID NO: 1865 - protein, 35 aa, Artificial Sequence
  Antimicrobial peptide sequence
GLVRILLRLLFRFGDSNSNSNGLLRILLRWLFRFG

SEQ ID NO: 1866 - protein, 35 aa, Artificial Sequence
  Antimicrobial peptide sequence
GLVRILLRLLFRFGDSNSNSNGLPWILLRWLFRRG

SEQ ID NO: 1867 - protein, 35 aa, Artificial Sequence
  Antimicrobial peptide sequence
GLVRILLRLLFRFGDNSNSNSGLPWILLRWLFFRG

SEQ ID NO: 1868 - protein, 35 aa, Artificial Sequence
  Antimicrobial peptide sequence
GLVRILLRLLFRFGDNSNSNSGLARILLRWLFFRG

SEQ ID NO: 1869 - protein, 35 aa, Artificial Sequence
  Antimicrobial peptide sequence
GLVRILLRLLFRFGDNSNSNSGLARILLRWLFRFG

SEQ ID NO: 1870 - protein, 35 aa, Artificial Sequence
  Antimicrobial peptide sequence
GLVRILLRLLFRFGDNSNSNSGLVRILLRWLFRFG

SEQ ID NO: 1871 - protein, 35 aa, Artificial Sequence
  Antimicrobial peptide sequence
GLVRILLRLLFRFGDNSNSNSGLARILLRLLFFRG

SEQ ID NO: 1872 - protein, 35 aa, Artificial Sequence
  Antimicrobial peptide sequence
GLVRILLRLLFRFGDNSNSNSGLARILLRLLFRFG

SEQ ID NO: 1873 - protein, 35 aa, Artificial Sequence
  Antimicrobial peptide sequence
GLVRILLRLLFRFGDNSNSNSGLVRILLRLLFRFG

SEQ ID NO: 1874 - protein, 35 aa, Artificial Sequence
  Antimicrobial peptide sequence
GLVRILLRLLFRFGDNSNSNSSLVRILLRLLLRFG

SEQ ID NO: 1875 - protein, 35 aa, Artificial Sequence
  Antimicrobial peptide sequence
GLVRILLRLLFRFGDNSNSNSGLVRILLRLLLRYG

SEQ ID NO: 1876 - protein, 35 aa, Artificial Sequence
  Antimicrobial peptide sequence
GLVRILLRLLFRFGDNSNSNSGLAWILLRWLFFRG

SEQ ID NO: 1877 - protein, 35 aa, Artificial Sequence
  Antimicrobial peptide sequence
GLVRILLRLLFRFGDNSNSNSGLVRILLRWLFFRG

SEQ ID NO: 1878 - protein, 35 aa, Artificial Sequence
  Antimicrobial peptide sequence
GLVRILLRLLFRFGDNSNSNSGLLRILLRWLFFRG

SEQ ID NO: 1879 - protein, 35 aa, Artificial Sequence
  Antimicrobial peptide sequence
GLVRILLRLLFRFGDNSNSNSGLPWILLRWLFRFG

SEQ ID NO: 1880 - protein, 35 aa, Artificial Sequence
  Antimicrobial peptide sequence
GLVRILLRLLFRFGDNSNSNSGLLRILLRWLFRFG

SEQ ID NO: 1881 - protein, 35 aa, Artificial Sequence
  Antimicrobial peptide sequence
GLVRILLRLLFRFGDNSNSNSGLPWILLRWLFRRG

SEQ ID NO: 1882 - protein, 35 aa, Artificial Sequence
  Antimicrobial peptide sequence
GLVRILLRLLFRFGDHGHGHGGLPWILLRWLFFRG

SEQ ID NO: 1883 - protein, 35 aa, Artificial Sequence
  Antimicrobial peptide sequence
GLVRILLRLLFRFGDHGHGHGGLARILLRWLFFRG

SEQ ID NO: 1884 - protein, 35 aa, Artificial Sequence
  Antimicrobial peptide sequence
GLVRILLRLLFRFGDHGHGHGGLARILLRWLFRFG

SEQ ID NO: 1885 - protein, 35 aa, Artificial Sequence
  Antimicrobial peptide sequence
GLVRILLRLLFRFGDHGHGHGGLVRILLRWLFRFG

SEQ ID NO: 1886 - protein, 35 aa, Artificial Sequence
  Antimicrobial peptide sequence
GLVRILLRLLFRFGDHGHGHGGLARILLRLLFFRG

SEQ ID NO: 1887 - protein, 35 aa, Artificial Sequence
  Antimicrobial peptide sequence
GLVRILLRLLFRFGDHGHGHGGLARILLRLLFRFG

SEQ ID NO: 1888 - protein, 35 aa, Artificial Sequence
  Antimicrobial peptide sequence
GLVRILLRLLFRFGDHGHGHGGLVRILLRLLFRFG

SEQ ID NO: 1889 - protein, 35 aa, Artificial Sequence
  Antimicrobial peptide sequence
GLVRILLRLLFRFGDHGHGHGSLVRILLRLLLRFG

SEQ ID NO: 1890 - protein, 35 aa, Artificial Sequence
  Antimicrobial peptide sequence
GLVRILLRLLFRFGDHGHGHGGLVRILLRLLLRYG

SEQ ID NO: 1891 - protein, 35 aa, Artificial Sequence
  Antimicrobial peptide sequence
GLVRILLRLLFRFGDHGHGHGGLAWILLRWLFFRG

SEQ ID NO: 1892 - protein, 35 aa, Artificial Sequence
  Antimicrobial peptide sequence
GLVRILLRLLFRFGDHGHGHGGLVRILLRWLFFRG

SEQ ID NO: 1893 - protein, 35 aa, Artificial Sequence
  Antimicrobial peptide sequence
GLVRILLRLLFRFGDHGHGHGGLLRILLRWLFFRG

SEQ ID NO: 1894 - protein, 35 aa, Artificial Sequence
  Antimicrobial peptide sequence
GLVRILLRLLFRFGDHGHGHGGLPWILLRWLFRFG

SEQ ID NO: 1895 - protein, 35 aa, Artificial Sequence
  Antimicrobial peptide sequence
GLVRILLRLLFRFGDHGHGHGGLLRILLRWLFRFG

SEQ ID NO: 1896 - protein, 35 aa, Artificial Sequence
  Antimicrobial peptide sequence
GLVRILLRLLFRFGDHGHGHGGLPWILLRWLFRRG

SEQ ID NO: 1897 - protein, 35 aa, Artificial Sequence
  Antimicrobial peptide sequence
GLVRILLRLLFRFGDGHGHGHGLPWILLRWLFFRG

SEQ ID NO: 1898 - protein, 35 aa, Artificial Sequence
  Antimicrobial peptide sequence
GLVRILLRLLFRFGDGHGHGHGLARILLRWLFFRG

SEQ ID NO: 1899 - protein, 35 aa, Artificial Sequence
  Antimicrobial peptide sequence
GLVRILLRLLFRFGDGHGHGHGLARILLRWLFRFG

SEQ ID NO: 1900 - protein, 35 aa, Artificial Sequence
  Antimicrobial peptide sequence
GLVRILLRLLFRFGDGHGHGHGLVRILLRWLFRFG

SEQ ID NO: 1901 - protein, 35 aa, Artificial Sequence
  Antimicrobial peptide sequence
GLVRILLRLLFRFGDGHGHGHGLARILLRLLFFRG

SEQ ID NO: 1902 - protein, 35 aa, Artificial Sequence
  Antimicrobial peptide sequence
GLVRILLRLLFRFGDGHGHGHGLARILLRLLFRFG

SEQ ID NO: 1903 - protein, 35 aa, Artificial Sequence
  Antimicrobial peptide sequence
GLVRILLRLLFRFGDGHGHGHGLVRILLRLLFRFG

SEQ ID NO: 1904 - protein, 35 aa, Artificial Sequence
  Antimicrobial peptide sequence
GLVRILLRLLFRFGDGHGHGHSLVRILLRLLLRFG

SEQ ID NO: 1905 - protein, 35 aa, Artificial Sequence
  Antimicrobial peptide sequence
GLVRILLRLLFRFGDGHGHGHGLVRILLRLLLRYG

SEQ ID NO: 1906 - protein, 35 aa, Artificial Sequence
  Antimicrobial peptide sequence
GLVRILLRLLFRFGDGHGHGHGLAWILLRWLFFRG

SEQ ID NO: 1907 - protein, 35 aa, Artificial Sequence
  Antimicrobial peptide sequence
GLVRILLRLLFRFGDGHGHGHGLVRILLRWLFFRG

SEQ ID NO: 1908 - protein, 35 aa, Artificial Sequence
  Antimicrobial peptide sequence
GLVRILLRLLFRFGDGHGHGHGLLRILLRWLFFRG

SEQ ID NO: 1909 - protein, 35 aa, Artificial Sequence
  Antimicrobial peptide sequence
GLVRILLRLLFRFGDGHGHGHGLPWILLRWLFRFG

SEQ ID NO: 1910 - protein, 35 aa, Artificial Sequence
  Antimicrobial peptide sequence
GLVRILLRLLFRFGDGHGHGHGLLRILLRWLFRFG

SEQ ID NO: 1911 - protein, 35 aa, Artificial Sequence
  Antimicrobial peptide sequence
GLVRILLRLLFRFGDGHGHGHGLPWILLRWLFRRG

SEQ ID NO: 1912 - protein, 35 aa, Artificial Sequence
  Antimicrobial peptide sequence
GLVRILLRLLFRFGDHNHNHNGLPWILLRWLFFRG

SEQ ID NO: 1913 - protein, 35 aa, Artificial Sequence
  Antimicrobial peptide sequence
GLVRILLRLLFRFGDHNHNHNGLARILLRWLFFRG

SEQ ID NO: 1914 - protein, 35 aa, Artificial Sequence
  Antimicrobial peptide sequence
GLVRILLRLLFRFGDHNHNHNGLARILLRWLFRFG

SEQ ID NO: 1915 - protein, 35 aa, Artificial Sequence
  Antimicrobial peptide sequence
GLVRILLRLLFRFGDHNHNHNGLVRILLRWLFRFG

SEQ ID NO: 1916 - protein, 35 aa, Artificial Sequence
  Antimicrobial peptide sequence
GLVRILLRLLFRFGDHNHNHNGLARILLRLLFFRG

SEQ ID NO: 1917 - protein, 35 aa, Artificial Sequence
  Antimicrobial peptide sequence
GLVRILLRLLFRFGDHNHNHNGLARILLRLLFRFG

SEQ ID NO: 1918 - protein, 35 aa, Artificial Sequence
  Antimicrobial peptide sequence
GLVRILLRLLFRFGDHNHNHNGLVRILLRLLFRFG

SEQ ID NO: 1919 - protein, 35 aa, Artificial Sequence
  Antimicrobial peptide sequence
GLVRILLRLLFRFGDHNHNHNSLVRILLRLLLRFG

SEQ ID NO: 1920 - protein, 35 aa, Artificial Sequence
  Antimicrobial peptide sequence
GLVRILLRLLFRFGDHNHNHNGLVRILLRLLLRYG

SEQ ID NO: 1921 - protein, 35 aa, Artificial Sequence
  Antimicrobial peptide sequence
GLVRILLRLLFRFGDHNHNHNGLAWILLRWLFFRG

SEQ ID NO: 1922 - protein, 35 aa, Artificial Sequence
  Antimicrobial peptide sequence
GLVRILLRLLFRFGDHNHNHNGLVRILLRWLFFRG

SEQ ID NO: 1923 - protein, 35 aa, Artificial Sequence
  Antimicrobial peptide sequence
GLVRILLRLLFRFGDHNHNHNGLLRILLRWLFFRG

SEQ ID NO: 1924 - protein, 35 aa, Artificial Sequence
  Antimicrobial peptide sequence
GLVRILLRLLFRFGDHNHNHNGLPWILLRWLFRFG

SEQ ID NO: 1925 - protein, 35 aa, Artificial Sequence
  Antimicrobial peptide sequence
GLVRILLRLLFRFGDHNHNHNGLLRILLRWLFRFG

SEQ ID NO: 1926 - protein, 35 aa, Artificial Sequence
  Antimicrobial peptide sequence
GLVRILLRLLFRFGDHNHNHNGLPWILLRWLFRRG

SEQ ID NO: 1927 - protein, 35 aa, Artificial Sequence
  Antimicrobial peptide sequence
GLVRILLRLLFRFGDNHNHNHGLPWILLRWLFFRG

SEQ ID NO: 1928 - protein, 35 aa, Artificial Sequence
  Antimicrobial peptide sequence
GLVRILLRLLFRFGDNHNHNHGLARILLRWLFFRG

SEQ ID NO: 1929 - protein, 35 aa, Artificial Sequence
  Antimicrobial peptide sequence
GLVRILLRLLFRFGDNHNHNHGLARILLRWLFRFG

SEQ ID NO: 1930 - protein, 35 aa, Artificial Sequence
  Antimicrobial peptide sequence
GLVRILLRLLFRFGDNHNHNHGLVRILLRWLFRFG

SEQ ID NO: 1931 - protein, 35 aa, Artificial Sequence
  Antimicrobial peptide sequence
GLVRILLRLLFRFGDNHNHNHGLARILLRLLFFRG

SEQ ID NO: 1932 - protein, 35 aa, Artificial Sequence
  Antimicrobial peptide sequence
GLVRILLRLLFRFGDNHNHNHGLARILLRLLFRFG

SEQ ID NO: 1933 - protein, 35 aa, Artificial Sequence
  Antimicrobial peptide sequence
GLVRILLRLLFRFGDNHNHNHGLVRILLRLLFRFG

SEQ ID NO: 1934 - protein, 35 aa, Artificial Sequence
  Antimicrobial peptide sequence
GLVRILLRLLFRFGDNHNHNHSLVRILLRLLLRFG

SEQ ID NO: 1935 - protein, 35 aa, Artificial Sequence
  Antimicrobial peptide sequence
GLVRILLRLLFRFGDNHNHNHGLVRILLRLLLRYG

SEQ ID NO: 1936 - protein, 35 aa, Artificial Sequence
  Antimicrobial peptide sequence
GLVRILLRLLFRFGDNHNHNHGLAWILLRWLFFRG

SEQ ID NO: 1937 - protein, 35 aa, Artificial Sequence
  Antimicrobial peptide sequence
GLVRILLRLLFRFGDNHNHNHGLVRILLRWLFFRG

SEQ ID NO: 1938 - protein, 35 aa, Artificial Sequence
  Antimicrobial peptide sequence
GLVRILLRLLFRFGDNHNHNHGLLRILLRWLFFRG

SEQ ID NO: 1939 - protein, 35 aa, Artificial Sequence
  Antimicrobial peptide sequence
GLVRILLRLLFRFGDNHNHNHGLPWILLRWLFRFG

SEQ ID NO: 1940 - protein, 35 aa, Artificial Sequence
  Antimicrobial peptide sequence
GLVRILLRLLFRFGDNHNHNHGLLRILLRWLFRFG

SEQ ID NO: 1941 - protein, 35 aa, Artificial Sequence
  Antimicrobial peptide sequence
GLVRILLRLLFRFGDNHNHNHGLPWILLRWLFRRG

SEQ ID NO: 1942 - protein, 33 aa, Artificial Sequence
  Antimicrobial peptide sequence
SLVRILLRLLLRFGDGGGGGLPWILLRWLFFRG

SEQ ID NO: 1943 - protein, 33 aa, Artificial Sequence
  Antimicrobial peptide sequence
SLVRILLRLLLRFGDGGGGGLARILLRWLFFRG

SEQ ID NO: 1944 - protein, 33 aa, Artificial Sequence
  Antimicrobial peptide sequence
SLVRILLRLLLRFGDGGGGGLARILLRWLFRFG

SEQ ID NO: 1945 - protein, 33 aa, Artificial Sequence
  Antimicrobial peptide sequence
SLVRILLRLLLRFGDGGGGGLVRILLRWLFRFG

SEQ ID NO: 1946 - protein, 33 aa, Artificial Sequence
  Antimicrobial peptide sequence
SLVRILLRLLLRFGDGGGGGLARILLRLLFFRG

SEQ ID NO: 1947 - protein, 33 aa, Artificial Sequence
  Antimicrobial peptide sequence
SLVRILLRLLLRFGDGGGGGLARILLRLLFRFG

SEQ ID NO: 1948 - protein, 33 aa, Artificial Sequence
  Antimicrobial peptide sequence
SLVRILLRLLLRFGDGGGGGLVRILLRLLFRFG

SEQ ID NO: 1949 - protein, 33 aa, Artificial Sequence
  Antimicrobial peptide sequence
SLVRILLRLLLRFGDGGGGSLVRILLRLLLRFG

SEQ ID NO: 1950 - protein, 33 aa, Artificial Sequence
  Antimicrobial peptide sequence
SLVRILLRLLLRFGDGGGGGLVRILLRLLLRYG

SEQ ID NO: 1951 - protein, 33 aa, Artificial Sequence
  Antimicrobial peptide sequence
SLVRILLRLLLRFGDGGGGGLAWILLRWLFFRG

SEQ ID NO: 1952 - protein, 33 aa, Artificial Sequence
  Antimicrobial peptide sequence
SLVRILLRLLLRFGDGGGGGLVRILLRWLFFRG

SEQ ID NO: 1953 - protein, 33 aa, Artificial Sequence
  Antimicrobial peptide sequence
SLVRILLRLLLRFGDGGGGGLLRILLRWLFFRG

SEQ ID NO: 1954 - protein, 33 aa, Artificial Sequence
  Antimicrobial peptide sequence
SLVRILLRLLLRFGDGGGGGLPWILLRWLFRFG

SEQ ID NO: 1955 - protein, 33 aa, Artificial Sequence
  Antimicrobial peptide sequence
SLVRILLRLLLRFGDGGGGGLLRILLRWLFRFG

SEQ ID NO: 1956 - protein, 33 aa, Artificial Sequence
  Antimicrobial peptide sequence
SLVRILLRLLLRFGDGGGGGLPWILLRWLFRRG

SEQ ID NO: 1957 - protein, 34 aa, Artificial Sequence
  Antimicrobial peptide sequence
SLVRILLRLLLRFGDGGGGGGLPWILLRWLFFRG

SEQ ID NO: 1958 - protein, 34 aa, Artificial Sequence
  Antimicrobial peptide sequence
SLVRILLRLLLRFGDGGGGGGLARILLRWLFFRG

SEQ ID NO: 1959 - protein, 34 aa, Artificial Sequence
  Antimicrobial peptide sequence
SLVRILLRLLLRFGDGGGGGGLARILLRWLFRFG

SEQ ID NO: 1960 - protein, 34 aa, Artificial Sequence
  Antimicrobial peptide sequence
SLVRILLRLLLRFGDGGGGGGLVRILLRWLFRFG

SEQ ID NO: 1961 - protein, 34 aa, Artificial Sequence
  Antimicrobial peptide sequence
SLVRILLRLLLRFGDGGGGGGLARILLRLLFFRG

SEQ ID NO: 1962 - protein, 34 aa, Artificial Sequence
  Antimicrobial peptide sequence
SLVRILLRLLLRFGDGGGGGGLARILLRLLFRFG

SEQ ID NO: 1963 - protein, 34 aa, Artificial Sequence
  Antimicrobial peptide sequence
SLVRILLRLLLRFGDGGGGGGLVRILLRLLFRFG

SEQ ID NO: 1964 - protein, 34 aa, Artificial Sequence
  Antimicrobial peptide sequence
SLVRILLRLLLRFGDGGGGGSLVRILLRLLLRFG

SEQ ID NO: 1965 - protein, 34 aa, Artificial Sequence
  Antimicrobial peptide sequence
SLVRILLRLLLRFGDGGGGGGLVRILLRLLLRYG

SEQ ID NO: 1966 - protein, 34 aa, Artificial Sequence
  Antimicrobial peptide sequence
SLVRILLRLLLRFGDGGGGGGLAWILLRWLFFRG

SEQ ID NO: 1967 - protein, 34 aa, Artificial Sequence
  Antimicrobial peptide sequence
SLVRILLRLLLRFGDGGGGGGLVRILLRWLFFRG

SEQ ID NO: 1968 - protein, 34 aa, Artificial Sequence
  Antimicrobial peptide sequence
SLVRILLRLLLRFGDGGGGGGLLRILLRWLFFRG

SEQ ID NO: 1969 - protein, 34 aa, Artificial Sequence
  Antimicrobial peptide sequence
SLVRILLRLLLRFGDGGGGGGLPWILLRWLFRFG

SEQ ID NO: 1970 - protein, 34 aa, Artificial Sequence
  Antimicrobial peptide sequence
SLVRILLRLLLRFGDGGGGGGLLRILLRWLFRFG

SEQ ID NO: 1971 - protein, 34 aa, Artificial Sequence
  Antimicrobial peptide sequence
SLVRILLRLLLRFGDGGGGGGLPWILLRWLFRRG

SEQ ID NO: 1972 - protein, 35 aa, Artificial Sequence
  Antimicrobial peptide sequence
SLVRILLRLLLRFGDGGGGGGGLPWILLRWLFFRG

SEQ ID NO: 1973 - protein, 35 aa, Artificial Sequence
  Antimicrobial peptide sequence
SLVRILLRLLLRFGDGGGGGGGLARILLRWLFFRG

SEQ ID NO: 1974 - protein, 35 aa, Artificial Sequence
  Antimicrobial peptide sequence
SLVRILLRLLLRFGDGGGGGGGLARILLRWLFRFG

SEQ ID NO: 1975 - protein, 35 aa, Artificial Sequence
  Antimicrobial peptide sequence
SLVRILLRLLLRFGDGGGGGGGLVRILLRWLFRFG

SEQ ID NO: 1976 - protein, 35 aa, Artificial Sequence
  Antimicrobial peptide sequence
SLVRILLRLLLRFGDGGGGGGGLARILLRLLFFRG

SEQ ID NO: 1977 - protein, 35 aa, Artificial Sequence
  Antimicrobial peptide sequence
SLVRILLRLLLRFGDGGGGGGGLARILLRLLFRFG

SEQ ID NO: 1978 - protein, 35 aa, Artificial Sequence
  Antimicrobial peptide sequence
SLVRILLRLLLRFGDGGGGGGGLVRILLRLLFRFG

SEQ ID NO: 1979 - protein, 35 aa, Artificial Sequence
  Antimicrobial peptide sequence
SLVRILLRLLLRFGDGGGGGGSLVRILLRLLLRFG

SEQ ID NO: 1980 - protein, 35 aa, Artificial Sequence
  Antimicrobial peptide sequence
SLVRILLRLLLRFGDGGGGGGGLVRILLRLLLRYG

SEQ ID NO: 1981 - protein, 35 aa, Artificial Sequence
  Antimicrobial peptide sequence
SLVRILLRLLLRFGDGGGGGGGLAWILLRWLFFRG

SEQ ID NO: 1982 - protein, 35 aa, Artificial Sequence
  Antimicrobial peptide sequence
SLVRILLRLLLRFGDGGGGGGGLVRILLRWLFFRG

SEQ ID NO: 1983 - protein, 35 aa, Artificial Sequence
  Antimicrobial peptide sequence
SLVRILLRLLLRFGDGGGGGGGLLRILLRWLFFRG

SEQ ID NO: 1984 - protein, 35 aa, Artificial Sequence
  Antimicrobial peptide sequence
SLVRILLRLLLRFGDGGGGGGGLPWILLRWLFRFG

SEQ ID NO: 1985 - protein, 35 aa, Artificial Sequence
  Antimicrobial peptide sequence
SLVRILLRLLLRFGDGGGGGGGLLRILLRWLFRFG

SEQ ID NO: 1986 - protein, 35 aa, Artificial Sequence
  Antimicrobial peptide sequence
SLVRILLRLLLRFGDGGGGGGGLPWILLRWLFRRG

SEQ ID NO: 1987 - protein, 36 aa, Artificial Sequence
  Antimicrobial peptide sequence
SLVRILLRLLLRFGDGGGGGGGGLPWILLRWLFFRG

SEQ ID NO: 1988 - protein, 36 aa, Artificial Sequence
  Antimicrobial peptide sequence
SLVRILLRLLLRFGDGGGGGGGGLARILLRWLFFRG

SEQ ID NO: 1989 - protein, 36 aa, Artificial Sequence
  Antimicrobial peptide sequence
SLVRILLRLLLRFGDGGGGGGGGLARILLRWLFRFG

SEQ ID NO: 1990 - protein, 36 aa, Artificial Sequence
  Antimicrobial peptide sequence
SLVRILLRLLLRFGDGGGGGGGGLVRILLRWLFRFG

SEQ ID NO: 1991 - protein, 36 aa, Artificial Sequence
  Antimicrobial peptide sequence
SLVRILLRLLLRFGDGGGGGGGGLARILLRLLFFRG

SEQ ID NO: 1992 - protein, 36 aa, Artificial Sequence
  Antimicrobial peptide sequence
SLVRILLRLLLRFGDGGGGGGGGLARILLRLLFRFG

SEQ ID NO: 1993 - protein, 36 aa, Artificial Sequence
  Antimicrobial peptide sequence
SLVRILLRLLLRFGDGGGGGGGGLVRILLRLLFRFG

SEQ ID NO: 1994 - protein, 36 aa, Artificial Sequence
  Antimicrobial peptide sequence
SLVRILLRLLLRFGDGGGGGGGSLVRILLRLLLRFG

SEQ ID NO: 1995 - protein, 36 aa, Artificial Sequence
  Antimicrobial peptide sequence
SLVRILLRLLLRFGDGGGGGGGGLVRILLRLLLRYG

SEQ ID NO: 1996 - protein, 36 aa, Artificial Sequence
  Antimicrobial peptide sequence
SLVRILLRLLLRFGDGGGGGGGGLAWILLRWLFFRG

SEQ ID NO: 1997 - protein, 36 aa, Artificial Sequence
  Antimicrobial peptide sequence
SLVRILLRLLLRFGDGGGGGGGGLVRILLRWLFFRG

SEQ ID NO: 1998 - protein, 36 aa, Artificial Sequence
  Antimicrobial peptide sequence
SLVRILLRLLLRFGDGGGGGGGGLLRILLRWLFFRG

SEQ ID NO: 1999 - protein, 36 aa, Artificial Sequence
  Antimicrobial peptide sequence
SLVRILLRLLLRFGDGGGGGGGGLPWILLRWLFRFG

SEQ ID NO: 2000 - protein, 36 aa, Artificial Sequence
  Antimicrobial peptide sequence
SLVRILLRLLLRFGDGGGGGGGGLLRILLRWLFRFG

SEQ ID NO: 2001 - protein, 36 aa, Artificial Sequence
  Antimicrobial peptide sequence
SLVRILLRLLLRFGDGGGGGGGGLPWILLRWLFRRG

SEQ ID NO: 2002 - protein, 33 aa, Artificial Sequence
  Antimicrobial peptide sequence
SLVRILLRLLLRFGDNNNNGLPWILLRWLFFRG

SEQ ID NO: 2003 - protein, 33 aa, Artificial Sequence
  Antimicrobial peptide sequence
SLVRILLRLLLRFGDNNNNGLARILLRWLFFRG

SEQ ID NO: 2004 - protein, 33 aa, Artificial Sequence
  Antimicrobial peptide sequence
SLVRILLRLLLRFGDNNNNGLARILLRWLFRFG

SEQ ID NO: 2005 - protein, 33 aa, Artificial Sequence
  Antimicrobial peptide sequence
SLVRILLRLLLRFGDNNNNGLVRILLRWLFRFG

SEQ ID NO: 2006 - protein, 33 aa, Artificial Sequence
  Antimicrobial peptide sequence
SLVRILLRLLLRFGDNNNNGLARILLRLLFFRG

SEQ ID NO: 2007 - protein, 33 aa, Artificial Sequence
  Antimicrobial peptide sequence
SLVRILLRLLLRFGDNNNNGLARILLRLLFRFG

SEQ ID NO: 2008 - protein, 33 aa, Artificial Sequence
  Antimicrobial peptide sequence
SLVRILLRLLLRFGDNNNNGLVRILLRLLFRFG

SEQ ID NO: 2009 - protein, 33 aa, Artificial Sequence
  Antimicrobial peptide sequence
SLVRILLRLLLRFGDNNNNSLVRILLRLLLRFG

SEQ ID NO: 2010 - protein, 33 aa, Artificial Sequence
  Antimicrobial peptide sequence
SLVRILLRLLLRFGDNNNNGLVRILLRLLLRYG

SEQ ID NO: 2011 - protein, 33 aa, Artificial Sequence
  Antimicrobial peptide sequence
SLVRILLRLLLRFGDNNNNGLAWILLRWLFFRG

SEQ ID NO: 2012 - protein, 33 aa, Artificial Sequence
  Antimicrobial peptide sequence
SLVRILLRLLLRFGDNNNNGLVRILLRWLFFRG

SEQ ID NO: 2013 - protein, 33 aa, Artificial Sequence
  Antimicrobial peptide sequence
SLVRILLRLLLRFGDNNNNGLLRILLRWLFFRG

SEQ ID NO: 2014 - protein, 33 aa, Artificial Sequence
  Antimicrobial peptide sequence
SLVRILLRLLLRFGDNNNNGLPWILLRWLFRFG

SEQ ID NO: 2015 - protein, 33 aa, Artificial Sequence
  Antimicrobial peptide sequence
SLVRILLRLLLRFGDNNNNGLLRILLRWLFRFG

SEQ ID NO: 2016 - protein, 33 aa, Artificial Sequence
  Antimicrobial peptide sequence
SLVRILLRLLLRFGDNNNNGLPWILLRWLFRRG

SEQ ID NO: 2017 - protein, 34 aa, Artificial Sequence
  Antimicrobial peptide sequence
SLVRILLRLLLRFGDNNNNNGLPWILLRWLFFRG

SEQ ID NO: 2018 - protein, 34 aa, Artificial Sequence
  Antimicrobial peptide sequence
SLVRILLRLLLRFGDNNNNNGLARILLRWLFFRG

SEQ ID NO: 2019 - protein, 34 aa, Artificial Sequence
  Antimicrobial peptide sequence
SLVRILLRLLLRFGDNNNNNGLARILLRWLFRFG

SEQ ID NO: 2020 - protein, 34 aa, Artificial Sequence
  Antimicrobial peptide sequence
SLVRILLRLLLRFGDNNNNNGLVRILLRWLFRFG

SEQ ID NO: 2021 - protein, 34 aa, Artificial Sequence
  Antimicrobial peptide sequence
SLVRILLRLLLRFGDNNNNNGLARILLRLLFFRG

SEQ ID NO: 2022 - protein, 34 aa, Artificial Sequence
  Antimicrobial peptide sequence
SLVRILLRLLLRFGDNNNNNGLARILLRLLFRFG

SEQ ID NO: 2023 - protein, 34 aa, Artificial Sequence
  Antimicrobial peptide sequence
SLVRILLRLLLRFGDNNNNNGLVRILLRLLFRFG

SEQ ID NO: 2024 - protein, 34 aa, Artificial Sequence
  Antimicrobial peptide sequence
SLVRILLRLLLRFGDNNNNNSLVRILLRLLLRFG

SEQ ID NO: 2025 - protein, 34 aa, Artificial Sequence
  Antimicrobial peptide sequence
SLVRILLRLLLRFGDNNNNNGLVRILLRLLLRYG

SEQ ID NO: 2026 - protein, 34 aa, Artificial Sequence
  Antimicrobial peptide sequence
SLVRILLRLLLRFGDNNNNNGLAWILLRWLFFRG

SEQ ID NO: 2027 - protein, 34 aa, Artificial Sequence
  Antimicrobial peptide sequence
SLVRILLRLLLRFGDNNNNNGLVRILLRWLFFRG

SEQ ID NO: 2028 - protein, 34 aa, Artificial Sequence
  Antimicrobial peptide sequence
SLVRILLRLLLRFGDNNNNNGLLRILLRWLFFRG

SEQ ID NO: 2029 - protein, 34 aa, Artificial Sequence
  Antimicrobial peptide sequence
SLVRILLRLLLRFGDNNNNNGLPWILLRWLFRFG

SEQ ID NO: 2030 - protein, 34 aa, Artificial Sequence
  Antimicrobial peptide sequence
SLVRILLRLLLRFGDNNNNNGLLRILLRWLFRFG

SEQ ID NO: 2031 - protein, 34 aa, Artificial Sequence
  Antimicrobial peptide sequence
SLVRILLRLLLRFGDNNNNNGLPWILLRWLFRRG

SEQ ID NO: 2032 - protein, 35 aa, Artificial Sequence
  Antimicrobial peptide sequence
SLVRILLRLLLRFGDNNNNNNGLPWILLRWLFFRG

SEQ ID NO: 2033 - protein, 35 aa, Artificial Sequence
  Antimicrobial peptide sequence
SLVRILLRLLLRFGDNNNNNNGLARILLRWLFFRG

SEQ ID NO: 2034 - protein, 35 aa, Artificial Sequence
  Antimicrobial peptide sequence
SLVRILLRLLLRFGDNNNNNNGLARILLRWLFRFG

SEQ ID NO: 2035 - protein, 35 aa, Artificial Sequence
  Antimicrobial peptide sequence
SLVRILLRLLLRFGDNNNNNNGLVRILLRWLFRFG

SEQ ID NO: 2036 - protein, 35 aa, Artificial Sequence
  Antimicrobial peptide sequence
SLVRILLRLLLRFGDNNNNNNGLARILLRLLFFRG

SEQ ID NO: 2037 - protein, 35 aa, Artificial Sequence
  Antimicrobial peptide sequence
SLVRILLRLLLRFGDNNNNNNGLARILLRLLFRFG

SEQ ID NO: 2038 - protein, 35 aa, Artificial Sequence
  Antimicrobial peptide sequence
SLVRILLRLLLRFGDNNNNNNGLVRILLRLLFRFG

SEQ ID NO: 2039 - protein, 35 aa, Artificial Sequence
  Antimicrobial peptide sequence
SLVRILLRLLLRFGDNNNNNNSLVRILLRLLLRFG

SEQ ID NO: 2040 - protein, 35 aa, Artificial Sequence
  Antimicrobial peptide sequence
SLVRILLRLLLRFGDNNNNNNGLVRILLRLLLRYG

SEQ ID NO: 2041 - protein, 35 aa, Artificial Sequence
  Antimicrobial peptide sequence
SLVRILLRLLLRFGDNNNNNNGLAWILLRWLFFRG

SEQ ID NO: 2042 - protein, 35 aa, Artificial Sequence
  Antimicrobial peptide sequence
SLVRILLRLLLRFGDNNNNNNGLVRILLRWLFFRG

SEQ ID NO: 2043 - protein, 35 aa, Artificial Sequence
  Antimicrobial peptide sequence
SLVRILLRLLLRFGDNNNNNNGLLRILLRWLFFRG

SEQ ID NO: 2044 - protein, 35 aa, Artificial Sequence
  Antimicrobial peptide sequence
SLVRILLRLLLRFGDNNNNNNGLPWILLRWLFRFG

SEQ ID NO: 2045 - protein, 35 aa, Artificial Sequence
  Antimicrobial peptide sequence
SLVRILLRLLLRFGDNNNNNNGLLRILLRWLFRFG

SEQ ID NO: 2046 - protein, 35 aa, Artificial Sequence
  Antimicrobial peptide sequence
SLVRILLRLLLRFGDNNNNNNGLPWILLRWLFRRG

SEQ ID NO: 2047 - protein, 36 aa, Artificial Sequence
  Antimicrobial peptide sequence
SLVRILLRLLLRFGDNNNNNNNGLPWILLRWLFFRG

SEQ ID NO: 2048 - protein, 36 aa, Artificial Sequence
  Antimicrobial peptide sequence
SLVRILLRLLLRFGDNNNNNNNGLARILLRWLFFRG

SEQ ID NO: 2049 - protein, 36 aa, Artificial Sequence
  Antimicrobial peptide sequence
SLVRILLRLLLRFGDNNNNNNNGLARILLRWLFRFG

SEQ ID NO: 2050 - protein, 36 aa, Artificial Sequence
  Antimicrobial peptide sequence
SLVRILLRLLLRFGDNNNNNNNGLVRILLRWLFRFG

SEQ ID NO: 2051 - protein, 36 aa, Artificial Sequence
  Antimicrobial peptide sequence
SLVRILLRLLLRFGDNNNNNNNGLARILLRLLFFRG

SEQ ID NO: 2052 - protein, 36 aa, Artificial Sequence
  Antimicrobial peptide sequence
SLVRILLRLLLRFGDNNNNNNNGLARILLRLLFRFG

SEQ ID NO: 2053 - protein, 36 aa, Artificial Sequence
  Antimicrobial peptide sequence
SLVRILLRLLLRFGDNNNNNNNGLVRILLRLLFRFG

SEQ ID NO: 2054 - protein, 36 aa, Artificial Sequence
  Antimicrobial peptide sequence
SLVRILLRLLLRFGDNNNNNNNSLVRILLRLLLRFG

SEQ ID NO: 2055 - protein, 36 aa, Artificial Sequence
  Antimicrobial peptide sequence
SLVRILLRLLLRFGDNNNNNNNGLVRILLRLLLRYG

SEQ ID NO: 2056 - protein, 36 aa, Artificial Sequence
  Antimicrobial peptide sequence
SLVRILLRLLLRFGDNNNNNNNGLAWILLRWLFFRG

SEQ ID NO: 2057 - protein, 36 aa, Artificial Sequence
  Antimicrobial peptide sequence
SLVRILLRLLLRFGDNNNNNNNGLVRILLRWLFFRG

SEQ ID NO: 2058 - protein, 36 aa, Artificial Sequence
  Antimicrobial peptide sequence
SLVRILLRLLLRFGDNNNNNNNGLLRILLRWLFFRG

SEQ ID NO: 2059 - protein, 36 aa, Artificial Sequence
  Antimicrobial peptide sequence
SLVRILLRLLLRFGDNNNNNNNGLPWILLRWLFRFG

SEQ ID NO: 2060 - protein, 36 aa, Artificial Sequence
  Antimicrobial peptide sequence
SLVRILLRLLLRFGDNNNNNNNGLLRILLRWLFRFG

SEQ ID NO: 2061 - protein, 36 aa, Artificial Sequence
  Antimicrobial peptide sequence
SLVRILLRLLLRFGDNNNNNNNGLPWILLRWLFRRG

SEQ ID NO: 2062 - protein, 35 aa, Artificial Sequence
  Antimicrobial peptide sequence
SLVRILLRLLLRFGDNGNGNGGLPWILLRWLFFRG

SEQ ID NO: 2063 - protein, 35 aa, Artificial Sequence
  Antimicrobial peptide sequence
SLVRILLRLLLRFGDNGNGNGGLARILLRWLFFRG

SEQ ID NO: 2064 - protein, 35 aa, Artificial Sequence
  Antimicrobial peptide sequence
SLVRILLRLLLRFGDNGNGNGGLARILLRWLFRFG

SEQ ID NO: 2065 - protein, 35 aa, Artificial Sequence
  Antimicrobial peptide sequence
SLVRILLRLLLRFGDNGNGNGGLVRILLRWLFRFG

SEQ ID NO: 2066 - protein, 35 aa, Artificial Sequence
  Antimicrobial peptide sequence
SLVRILLRLLLRFGDNGNGNGGLARILLRLLFFRG

SEQ ID NO: 2067 - protein, 35 aa, Artificial Sequence
  Antimicrobial peptide sequence
SLVRILLRLLLRFGDNGNGNGGLARILLRLLFRFG

SEQ ID NO: 2068 - protein, 35 aa, Artificial Sequence
  Antimicrobial peptide sequence
SLVRILLRLLLRFGDNGNGNGGLVRILLRLLFRFG

SEQ ID NO: 2069 - protein, 35 aa, Artificial Sequence
  Antimicrobial peptide sequence
SLVRILLRLLLRFGDNGNGNGSLVRILLRLLLRFG

SEQ ID NO: 2070 - protein, 35 aa, Artificial Sequence
  Antimicrobial peptide sequence
SLVRILLRLLLRFGDNGNGNGGLVRILLRLLLRYG

SEQ ID NO: 2071 - protein, 35 aa, Artificial Sequence
  Antimicrobial peptide sequence
SLVRILLRLLLRFGDNGNGNGGLAWILLRWLFFRG

SEQ ID NO: 2072 - protein, 35 aa, Artificial Sequence
  Antimicrobial peptide sequence
SLVRILLRLLLRFGDNGNGNGGLVRILLRWLFFRG

SEQ ID NO: 2073 - protein, 35 aa, Artificial Sequence
  Antimicrobial peptide sequence
SLVRILLRLLLRFGDNGNGNGGLLRILLRWLFFRG

SEQ ID NO: 2074 - protein, 35 aa, Artificial Sequence
  Antimicrobial peptide sequence
SLVRILLRLLLRFGDNGNGNGGLPWILLRWLFRFG

SEQ ID NO: 2075 - protein, 35 aa, Artificial Sequence
  Antimicrobial peptide sequence
SLVRILLRLLLRFGDNGNGNGGLLRILLRWLFRFG

SEQ ID NO: 2076 - protein, 35 aa, Artificial Sequence
  Antimicrobial peptide sequence
SLVRILLRLLLRFGDNGNGNGGLPWILLRWLFRRG

SEQ ID NO: 2077 - protein, 35 aa, Artificial Sequence
  Antimicrobial peptide sequence
SLVRILLRLLLRFGDGNGNGNGLPWILLRWLFFRG

SEQ ID NO: 2078 - protein, 35 aa, Artificial Sequence
  Antimicrobial peptide sequence
SLVRILLRLLLRFGDGNGNGNGLARILLRWLFFRG

SEQ ID NO: 2079 - protein, 35 aa, Artificial Sequence
  Antimicrobial peptide sequence
SLVRILLRLLLRFGDGNGNGNGLARILLRWLFRFG

SEQ ID NO: 2080 - protein, 35 aa, Artificial Sequence
  Antimicrobial peptide sequence
SLVRILLRLLLRFGDGNGNGNGLVRILLRWLFRFG

SEQ ID NO: 2081 - protein, 35 aa, Artificial Sequence
  Antimicrobial peptide sequence
SLVRILLRLLLRFGDGNGNGNGLARILLRLLFFRG

SEQ ID NO: 2082 - protein, 35 aa, Artificial Sequence
  Antimicrobial peptide sequence
SLVRILLRLLLRFGDGNGNGNGLARILLRLLFRFG

SEQ ID NO: 2083 - protein, 35 aa, Artificial Sequence
  Antimicrobial peptide sequence
SLVRILLRLLLRFGDGNGNGNGLVRILLRLLFRFG

SEQ ID NO: 2084 - protein, 35 aa, Artificial Sequence
  Antimicrobial peptide sequence
SLVRILLRLLLRFGDGNGNGNSLVRILLRLLLRFG

SEQ ID NO: 2085 - protein, 35 aa, Artificial Sequence
  Antimicrobial peptide sequence
SLVRILLRLLLRFGDGNGNGNGLVRILLRLLLRYG

SEQ ID NO: 2086 - protein, 35 aa, Artificial Sequence
  Antimicrobial peptide sequence
SLVRILLRLLLRFGDGNGNGNGLAWILLRWLFFRG

SEQ ID NO: 2087 - protein, 35 aa, Artificial Sequence
  Antimicrobial peptide sequence
SLVRILLRLLLRFGDGNGNGNGLVRILLRWLFFRG

SEQ ID NO: 2088 - protein, 35 aa, Artificial Sequence
  Antimicrobial peptide sequence
SLVRILLRLLLRFGDGNGNGNGLLRILLRWLFFRG

SEQ ID NO: 2089 - protein, 35 aa, Artificial Sequence
  Antimicrobial peptide sequence
SLVRILLRLLLRFGDGNGNGNGLPWILLRWLFRFG

SEQ ID NO: 2090 - protein, 35 aa, Artificial Sequence
  Antimicrobial peptide sequence
SLVRILLRLLLRFGDGNGNGNGLLRILLRWLFRFG

SEQ ID NO: 2091 - protein, 35 aa, Artificial Sequence
  Antimicrobial peptide sequence
SLVRILLRLLLRFGDGNGNGNGLPWILLRWLFRRG

SEQ ID NO: 2092 - protein, 35 aa, Artificial Sequence
  Antimicrobial peptide sequence
SLVRILLRLLLRFGDSGSGSGGLPWILLRWLFFRG

SEQ ID NO: 2093 - protein, 35 aa, Artificial Sequence
  Antimicrobial peptide sequence
SLVRILLRLLLRFGDSGSGSGGLARILLRWLFFRG

SEQ ID NO: 2094 - protein, 35 aa, Artificial Sequence
  Antimicrobial peptide sequence
SLVRILLRLLLRFGDSGSGSGGLARILLRWLFRFG

SEQ ID NO: 2095 - protein, 35 aa, Artificial Sequence
  Antimicrobial peptide sequence
SLVRILLRLLLRFGDSGSGSGGLVRILLRWLFRFG

SEQ ID NO: 2096 - protein, 35 aa, Artificial Sequence
  Antimicrobial peptide sequence
SLVRILLRLLLRFGDSGSGSGGLARILLRLLFFRG

SEQ ID NO: 2097 - protein, 35 aa, Artificial Sequence
  Antimicrobial peptide sequence
SLVRILLRLLLRFGDSGSGSGGLARILLRLLFRFG

SEQ ID NO: 2098 - protein, 35 aa, Artificial Sequence
  Antimicrobial peptide sequence
SLVRILLRLLLRFGDSGSGSGGLVRILLRLLFRFG

SEQ ID NO: 2099 - protein, 35 aa, Artificial Sequence
  Antimicrobial peptide sequence
SLVRILLRLLLRFGDSGSGSGSLVRILLRLLLRFG

SEQ ID NO: 2100 - protein, 35 aa, Artificial Sequence
  Antimicrobial peptide sequence
SLVRILLRLLLRFGDSGSGSGGLVRILLRLLLRYG

SEQ ID NO: 2101 - protein, 35 aa, Artificial Sequence
  Antimicrobial peptide sequence
SLVRILLRLLLRFGDSGSGSGGLAWILLRWLFFRG

SEQ ID NO: 2102 - protein, 35 aa, Artificial Sequence
  Antimicrobial peptide sequence
SLVRILLRLLLRFGDSGSGSGGLVRILLRWLFFRG

SEQ ID NO: 2103 - protein, 35 aa, Artificial Sequence
  Antimicrobial peptide sequence
SLVRILLRLLLRFGDSGSGSGGLLRILLRWLFFRG

SEQ ID NO: 2104 - protein, 35 aa, Artificial Sequence
  Antimicrobial peptide sequence
SLVRILLRLLLRFGDSGSGSGGLPWILLRWLFRFG

SEQ ID NO: 2105 - protein, 35 aa, Artificial Sequence
  Antimicrobial peptide sequence
SLVRILLRLLLRFGDSGSGSGGLLRILLRWLFRFG

SEQ ID NO: 2106 - protein, 35 aa, Artificial Sequence
  Antimicrobial peptide sequence
SLVRILLRLLLRFGDSGSGSGGLPWILLRWLFRRG

SEQ ID NO: 2107 - protein, 35 aa, Artificial Sequence
  Antimicrobial peptide sequence
SLVRILLRLLLRFGDGSGSGSGLPWILLRWLFFRG

SEQ ID NO: 2108 - protein, 35 aa, Artificial Sequence
  Antimicrobial peptide sequence
SLVRILLRLLLRFGDGSGSGSGLARILLRWLFFRG

SEQ ID NO: 2109 - protein, 35 aa, Artificial Sequence
  Antimicrobial peptide sequence
SLVRILLRLLLRFGDGSGSGSGLARILLRWLFRFG

SEQ ID NO: 2110 - protein, 35 aa, Artificial Sequence
  Antimicrobial peptide sequence
SLVRILLRLLLRFGDGSGSGSGLVRILLRWLFRFG

SEQ ID NO: 2111 - protein, 35 aa, Artificial Sequence
  Antimicrobial peptide sequence
SLVRILLRLLLRFGDGSGSGSGLARILLRLLFFRG

SEQ ID NO: 2112 - protein, 35 aa, Artificial Sequence
  Antimicrobial peptide sequence
SLVRILLRLLLRFGDGSGSGSGLARILLRLLFRFG

SEQ ID NO: 2113 - protein, 35 aa, Artificial Sequence
  Antimicrobial peptide sequence
SLVRILLRLLLRFGDGSGSGSGLVRILLRLLFRFG

SEQ ID NO: 2114 - protein, 35 aa, Artificial Sequence
  Antimicrobial peptide sequence
SLVRILLRLLLRFGDGSGSGSSLVRILLRLLLRFG

SEQ ID NO: 2115 - protein, 35 aa, Artificial Sequence
  Antimicrobial peptide sequence
SLVRILLRLLLRFGDGSGSGSGLVRILLRLLLRYG

SEQ ID NO: 2116 - protein, 35 aa, Artificial Sequence
  Antimicrobial peptide sequence
SLVRILLRLLLRFGDGSGSGSGLAWILLRWLFFRG

SEQ ID NO: 2117 - protein, 35 aa, Artificial Sequence
  Antimicrobial peptide sequence
SLVRILLRLLLRFGDGSGSGSGLVRILLRWLFFRG

SEQ ID NO: 2118 - protein, 35 aa, Artificial Sequence
  Antimicrobial peptide sequence
SLVRILLRLLLRFGDGSGSGSGLLRILLRWLFFRG

SEQ ID NO: 2119 - protein, 35 aa, Artificial Sequence
  Antimicrobial peptide sequence
SLVRILLRLLLRFGDGSGSGSGLPWILLRWLFRFG

SEQ ID NO: 2120 - protein, 35 aa, Artificial Sequence
  Antimicrobial peptide sequence
SLVRILLRLLLRFGDGSGSGSGLLRILLRWLFRFG

SEQ ID NO: 2121 - protein, 35 aa, Artificial Sequence
  Antimicrobial peptide sequence
SLVRILLRLLLRFGDGSGSGSGLPWILLRWLFRRG

SEQ ID NO: 2122 - protein, 35 aa, Artificial Sequence
  Antimicrobial peptide sequence
SLVRILLRLLLRFGDSNSNSNGLPWILLRWLFFRG

SEQ ID NO: 2123 - protein, 35 aa, Artificial Sequence
  Antimicrobial peptide sequence
SLVRILLRLLLRFGDSNSNSNGLARILLRWLFFRG

SEQ ID NO: 2124 - protein, 35 aa, Artificial Sequence
  Antimicrobial peptide sequence
SLVRILLRLLLRFGDSNSNSNGLARILLRWLFRFG

SEQ ID NO: 2125 - protein, 35 aa, Artificial Sequence
  Antimicrobial peptide sequence
SLVRILLRLLLRFGDSNSNSNGLVRILLRWLFRFG

SEQ ID NO: 2126 - protein, 35 aa, Artificial Sequence
  Antimicrobial peptide sequence
SLVRILLRLLLRFGDSNSNSNGLARILLRLLFFRG

SEQ ID NO: 2127 - protein, 35 aa, Artificial Sequence
  Antimicrobial peptide sequence
SLVRILLRLLLRFGDSNSNSNGLARILLRLLFRFG

SEQ ID NO: 2128 - protein, 35 aa, Artificial Sequence
  Antimicrobial peptide sequence
SLVRILLRLLLRFGDSNSNSNGLVRILLRLLFRFG

SEQ ID NO: 2129 - protein, 35 aa, Artificial Sequence
  Antimicrobial peptide sequence
SLVRILLRLLLRFGDSNSNSNSLVRILLRLLLRFG

SEQ ID NO: 2130 - protein, 35 aa, Artificial Sequence
  Antimicrobial peptide sequence
SLVRILLRLLLRFGDSNSNSNGLVRILLRLLLRYG

SEQ ID NO: 2131 - protein, 35 aa, Artificial Sequence
  Antimicrobial peptide sequence
SLVRILLRLLLRFGDSNSNSNGLAWILLRWLFFRG

SEQ ID NO: 2132 - protein, 35 aa, Artificial Sequence
  Antimicrobial peptide sequence
SLVRILLRLLLRFGDSNSNSNGLVRILLRWLFFRG

SEQ ID NO: 2133 - protein, 35 aa, Artificial Sequence
  Antimicrobial peptide sequence
SLVRILLRLLLRFGDSNSNSNGLLRILLRWLFFRG

SEQ ID NO: 2134 - protein, 35 aa, Artificial Sequence
  Antimicrobial peptide sequence
SLVRILLRLLLRFGDSNSNSNGLPWILLRWLFRFG

SEQ ID NO: 2135 - protein, 35 aa, Artificial Sequence
  Antimicrobial peptide sequence
SLVRILLRLLLRFGDSNSNSNGLLRILLRWLFRFG

SEQ ID NO: 2136 - protein, 35 aa, Artificial Sequence
  Antimicrobial peptide sequence
SLVRILLRLLLRFGDSNSNSNGLPWILLRWLFRRG

SEQ ID NO: 2137 - protein, 35 aa, Artificial Sequence
  Antimicrobial peptide sequence
SLVRILLRLLLRFGDNSNSNSGLPWILLRWLFFRG

SEQ ID NO: 2138 - protein, 35 aa, Artificial Sequence
  Antimicrobial peptide sequence
SLVRILLRLLLRFGDNSNSNSGLARILLRWLFFRG

SEQ ID NO: 2139 - protein, 35 aa, Artificial Sequence
  Antimicrobial peptide sequence
SLVRILLRLLLRFGDNSNSNSGLARILLRWLFRFG

SEQ ID NO: 2140 - protein, 35 aa, Artificial Sequence
  Antimicrobial peptide sequence
SLVRILLRLLLRFGDNSNSNSGLVRILLRWLFRFG

SEQ ID NO: 2141 - protein, 35 aa, Artificial Sequence
  Antimicrobial peptide sequence
SLVRILLRLLLRFGDNSNSNSGLARILLRLLFFRG

SEQ ID NO: 2142 - protein, 35 aa, Artificial Sequence
  Antimicrobial peptide sequence
SLVRILLRLLLRFGDNSNSNSGLARILLRLLFRFG

SEQ ID NO: 2143 - protein, 35 aa, Artificial Sequence
  Antimicrobial peptide sequence
SLVRILLRLLLRFGDNSNSNSGLVRILLRLLFRFG

SEQ ID NO: 2144 - protein, 35 aa, Artificial Sequence
  Antimicrobial peptide sequence
SLVRILLRLLLRFGDNSNSNSSLVRILLRLLLRFG

SEQ ID NO: 2145 - protein, 35 aa, Artificial Sequence
  Antimicrobial peptide sequence
SLVRILLRLLLRFGDNSNSNSGLVRILLRLLLRYG

SEQ ID NO: 2146 - protein, 35 aa, Artificial Sequence
  Antimicrobial peptide sequence
SLVRILLRLLLRFGDNSNSNSGLAWILLRWLFFRG

SEQ ID NO: 2147 - protein, 35 aa, Artificial Sequence
  Antimicrobial peptide sequence
SLVRILLRLLLRFGDNSNSNSGLVRILLRWLFFRG

SEQ ID NO: 2148 - protein, 35 aa, Artificial Sequence
  Antimicrobial peptide sequence
SLVRILLRLLLRFGDNSNSNSGLLRILLRWLFFRG

SEQ ID NO: 2149 - protein, 35 aa, Artificial Sequence
  Antimicrobial peptide sequence
SLVRILLRLLLRFGDNSNSNSGLPWILLRWLFRFG

SEQ ID NO: 2150 - protein, 35 aa, Artificial Sequence
  Antimicrobial peptide sequence
SLVRILLRLLLRFGDNSNSNSGLLRILLRWLFRFG

SEQ ID NO: 2151 - protein, 35 aa, Artificial Sequence
  Antimicrobial peptide sequence
SLVRILLRLLLRFGDNSNSNSGLPWILLRWLFRRG

SEQ ID NO: 2152 - protein, 35 aa, Artificial Sequence
  Antimicrobial peptide sequence
SLVRILLRLLLRFGDHGHGHGGLPWILLRWLFFRG

SEQ ID NO: 2153 - protein, 35 aa, Artificial Sequence
  Antimicrobial peptide sequence
SLVRILLRLLLRFGDHGHGHGGLARILLRWLFFRG

SEQ ID NO: 2154 - protein, 35 aa, Artificial Sequence
  Antimicrobial peptide sequence
SLVRILLRLLLRFGDHGHGHGGLARILLRWLFRFG

SEQ ID NO: 2155 - protein, 35 aa, Artificial Sequence
  Antimicrobial peptide sequence
SLVRILLRLLLRFGDHGHGHGGLVRILLRWLFRFG

SEQ ID NO: 2156 - protein, 35 aa, Artificial Sequence
  Antimicrobial peptide sequence
SLVRILLRLLLRFGDHGHGHGGLARILLRLLFFRG

SEQ ID NO: 2157 - protein, 35 aa, Artificial Sequence
  Antimicrobial peptide sequence
SLVRILLRLLLRFGDHGHGHGGLARILLRLLFRFG

SEQ ID NO: 2158 - protein, 35 aa, Artificial Sequence
  Antimicrobial peptide sequence
SLVRILLRLLLRFGDHGHGHGGLVRILLRLLFRFG

SEQ ID NO: 2159 - protein, 35 aa, Artificial Sequence
  Antimicrobial peptide sequence
SLVRILLRLLLRFGDHGHGHGSLVRILLRLLLRFG

SEQ ID NO: 2160 - protein, 35 aa, Artificial Sequence
  Antimicrobial peptide sequence
SLVRILLRLLLRFGDHGHGHGGLVRILLRLLLRYG

SEQ ID NO: 2161 - protein, 35 aa, Artificial Sequence
  Antimicrobial peptide sequence
SLVRILLRLLLRFGDHGHGHGGLAWILLRWLFFRG

SEQ ID NO: 2162 - protein, 35 aa, Artificial Sequence
  Antimicrobial peptide sequence
SLVRILLRLLLRFGDHGHGHGGLVRILLRWLFFRG

SEQ ID NO: 2163 - protein, 35 aa, Artificial Sequence
  Antimicrobial peptide sequence
SLVRILLRLLLRFGDHGHGHGGLLRILLRWLFFRG

SEQ ID NO: 2164 - protein, 35 aa, Artificial Sequence
  Antimicrobial peptide sequence
SLVRILLRLLLRFGDHGHGHGGLPWILLRWLFRFG

SEQ ID NO: 2165 - protein, 35 aa, Artificial Sequence
  Antimicrobial peptide sequence
SLVRILLRLLLRFGDHGHGHGGLLRILLRWLFRFG

SEQ ID NO: 2166 - protein, 35 aa, Artificial Sequence
  Antimicrobial peptide sequence
SLVRILLRLLLRFGDHGHGHGGLPWILLRWLFRRG

SEQ ID NO: 2167 - protein, 35 aa, Artificial Sequence
  Antimicrobial peptide sequence
SLVRILLRLLLRFGDGHGHGHGLPWILLRWLFFRG

SEQ ID NO: 2168 - protein, 35 aa, Artificial Sequence
  Antimicrobial peptide sequence
SLVRILLRLLLRFGDGHGHGHGLARILLRWLFFRG

SEQ ID NO: 2169 - protein, 35 aa, Artificial Sequence
  Antimicrobial peptide sequence
SLVRILLRLLLRFGDGHGHGHGLARILLRWLFRFG

SEQ ID NO: 2170 - protein, 35 aa, Artificial Sequence
  Antimicrobial peptide sequence
SLVRILLRLLLRFGDGHGHGHGLVRILLRWLFRFG

SEQ ID NO: 2171 - protein, 35 aa, Artificial Sequence
  Antimicrobial peptide sequence
SLVRILLRLLLRFGDGHGHGHGLARILLRLLFFRG

SEQ ID NO: 2172 - protein, 35 aa, Artificial Sequence
  Antimicrobial peptide sequence
SLVRILLRLLLRFGDGHGHGHGLARILLRLLFRFG

SEQ ID NO: 2173 - protein, 35 aa, Artificial Sequence
  Antimicrobial peptide sequence
SLVRILLRLLLRFGDGHGHGHGLVRILLRLLFRFG

SEQ ID NO: 2174 - protein, 35 aa, Artificial Sequence
  Antimicrobial peptide sequence
SLVRILLRLLLRFGDGHGHGHSLVRILLRLLLRFG

SEQ ID NO: 2175 - protein, 35 aa, Artificial Sequence
  Antimicrobial peptide sequence
SLVRILLRLLLRFGDGHGHGHGLVRILLRLLLRYG

SEQ ID NO: 2176 - protein, 35 aa, Artificial Sequence
  Antimicrobial peptide sequence
SLVRILLRLLLRFGDGHGHGHGLAWILLRWLFFRG

SEQ ID NO: 2177 - protein, 35 aa, Artificial Sequence
  Antimicrobial peptide sequence
SLVRILLRLLLRFGDGHGHGHGLVRILLRWLFFRG

SEQ ID NO: 2178 - protein, 35 aa, Artificial Sequence
  Antimicrobial peptide sequence
SLVRILLRLLLRFGDGHGHGHGLLRILLRWLFFRG

SEQ ID NO: 2179 - protein, 35 aa, Artificial Sequence
  Antimicrobial peptide sequence
SLVRILLRLLLRFGDGHGHGHGLPWILLRWLFRFG

SEQ ID NO: 2180 - protein, 35 aa, Artificial Sequence
  Antimicrobial peptide sequence
SLVRILLRLLLRFGDGHGHGHGLLRILLRWLFRFG

SEQ ID NO: 2181 - protein, 35 aa, Artificial Sequence
  Antimicrobial peptide sequence
SLVRILLRLLLRFGDGHGHGHGLPWILLRWLFRRG

SEQ ID NO: 2182 - protein, 35 aa, Artificial Sequence
  Antimicrobial peptide sequence
SLVRILLRLLLRFGDHNHNHNGLPWILLRWLFFRG

SEQ ID NO: 2183 - protein, 35 aa, Artificial Sequence
  Antimicrobial peptide sequence
SLVRILLRLLLRFGDHNHNHNGLARILLRWLFFRG

SEQ ID NO: 2184 - protein, 35 aa, Artificial Sequence
  Antimicrobial peptide sequence
SLVRILLRLLLRFGDHNHNHNGLARILLRWLFRFG

SEQ ID NO: 2185 - protein, 35 aa, Artificial Sequence
  Antimicrobial peptide sequence
SLVRILLRLLLRFGDHNHNHNGLVRILLRWLFRFG

SEQ ID NO: 2186 - protein, 35 aa, Artificial Sequence
  Antimicrobial peptide sequence
SLVRILLRLLLRFGDHNHNHNGLARILLRLLFFRG

SEQ ID NO: 2187 - protein, 35 aa, Artificial Sequence
  Antimicrobial peptide sequence
SLVRILLRLLLRFGDHNHNHNGLARILLRLLFRFG

SEQ ID NO: 2188 - protein, 35 aa, Artificial Sequence
  Antimicrobial peptide sequence
SLVRILLRLLLRFGDHNHNHNGLVRILLRLLFRFG

SEQ ID NO: 2189 - protein, 35 aa, Artificial Sequence
  Antimicrobial peptide sequence
SLVRILLRLLLRFGDHNHNHNSLVRILLRLLLRFG

SEQ ID NO: 2190 - protein, 35 aa, Artificial Sequence
  Antimicrobial peptide sequence
SLVRILLRLLLRFGDHNHNHNGLVRILLRLLLRYG

SEQ ID NO: 2191 - protein, 35 aa, Artificial Sequence
  Antimicrobial peptide sequence
SLVRILLRLLLRFGDHNHNHNGLAWILLRWLFFRG

SEQ ID NO: 2192 - protein, 35 aa, Artificial Sequence
  Antimicrobial peptide sequence
SLVRILLRLLLRFGDHNHNHNGLVRILLRWLFFRG

SEQ ID NO: 2193 - protein, 35 aa, Artificial Sequence
  Antimicrobial peptide sequence
SLVRILLRLLLRFGDHNHNHNGLLRILLRWLFFRG

SEQ ID NO: 2194 - protein, 35 aa, Artificial Sequence
  Antimicrobial peptide sequence
SLVRILLRLLLRFGDHNHNHNGLPWILLRWLFRFG

SEQ ID NO: 2195 - protein, 35 aa, Artificial Sequence
  Antimicrobial peptide sequence
SLVRILLRLLLRFGDHNHNHNGLLRILLRWLFRFG

SEQ ID NO: 2196 - protein, 35 aa, Artificial Sequence
  Antimicrobial peptide sequence
SLVRILLRLLLRFGDHNHNHNGLPWILLRWLFRRG

SEQ ID NO: 2197 - protein, 35 aa, Artificial Sequence
  Antimicrobial peptide sequence
SLVRILLRLLLRFGDNHNHNHGLPWILLRWLFFRG

SEQ ID NO: 2198 - protein, 35 aa, Artificial Sequence
  Antimicrobial peptide sequence
SLVRILLRLLLRFGDNHNHNHGLARILLRWLFFRG

SEQ ID NO: 2199 - protein, 35 aa, Artificial Sequence
  Antimicrobial peptide sequence
SLVRILLRLLLRFGDNHNHNHGLARILLRWLFRFG

SEQ ID NO: 2200 - protein, 35 aa, Artificial Sequence
  Antimicrobial peptide sequence
SLVRILLRLLLRFGDNHNHNHGLVRILLRWLFRFG

SEQ ID NO: 2201 - protein, 35 aa, Artificial Sequence
  Antimicrobial peptide sequence
SLVRILLRLLLRFGDNHNHNHGLARILLRLLFFRG

SEQ ID NO: 2202 - protein, 35 aa, Artificial Sequence
  Antimicrobial peptide sequence
SLVRILLRLLLRFGDNHNHNHGLARILLRLLFRFG

SEQ ID NO: 2203 - protein, 35 aa, Artificial Sequence
  Antimicrobial peptide sequence
SLVRILLRLLLRFGDNHNHNHGLVRILLRLLFRFG

SEQ ID NO: 2204 - protein, 35 aa, Artificial Sequence
  Antimicrobial peptide sequence
SLVRILLRLLLRFGDNHNHNHSLVRILLRLLLRFG

SEQ ID NO: 2205 - protein, 35 aa, Artificial Sequence
  Antimicrobial peptide sequence
SLVRILLRLLLRFGDNHNHNHGLVRILLRLLLRYG

SEQ ID NO: 2206 - protein, 35 aa, Artificial Sequence
  Antimicrobial peptide sequence
SLVRILLRLLLRFGDNHNHNHGLAWILLRWLFFRG

SEQ ID NO: 2207 - protein, 35 aa, Artificial Sequence
  Antimicrobial peptide sequence
SLVRILLRLLLRFGDNHNHNHGLVRILLRWLFFRG

SEQ ID NO: 2208 - protein, 35 aa, Artificial Sequence
  Antimicrobial peptide sequence
SLVRILLRLLLRFGDNHNHNHGLLRILLRWLFFRG

SEQ ID NO: 2209 - protein, 35 aa, Artificial Sequence
  Antimicrobial peptide sequence
SLVRILLRLLLRFGDNHNHNHGLPWILLRWLFRFG

SEQ ID NO: 2210 - protein, 35 aa, Artificial Sequence
  Antimicrobial peptide sequence
SLVRILLRLLLRFGDNHNHNHGLLRILLRWLFRFG

SEQ ID NO: 2211 - protein, 35 aa, Artificial Sequence
  Antimicrobial peptide sequence
SLVRILLRLLLRFGDNHNHNHGLPWILLRWLFRRG

SEQ ID NO: 2212 - protein, 33 aa, Artificial Sequence
  Antimicrobial peptide sequence
GLVRILLRLLLRYGDGGGGGLPWILLRWLFFRG

SEQ ID NO: 2213 - protein, 33 aa, Artificial Sequence
  Antimicrobial peptide sequence
GLVRILLRLLLRYGDGGGGGLARILLRWLFFRG

SEQ ID NO: 2214 - protein, 33 aa, Artificial Sequence
  Antimicrobial peptide sequence
GLVRILLRLLLRYGDGGGGGLARILLRWLFRFG

SEQ ID NO: 2215 - protein, 33 aa, Artificial Sequence
  Antimicrobial peptide sequence
GLVRILLRLLLRYGDGGGGGLVRILLRWLFRFG

SEQ ID NO: 2216 - protein, 33 aa, Artificial Sequence
  Antimicrobial peptide sequence
GLVRILLRLLLRYGDGGGGGLARILLRLLFFRG

SEQ ID NO: 2217 - protein, 33 aa, Artificial Sequence
  Antimicrobial peptide sequence
GLVRILLRLLLRYGDGGGGGLARILLRLLFRFG

SEQ ID NO: 2218 - protein, 33 aa, Artificial Sequence
  Antimicrobial peptide sequence
GLVRILLRLLLRYGDGGGGGLVRILLRLLFRFG

SEQ ID NO: 2219 - protein, 33 aa, Artificial Sequence
  Antimicrobial peptide sequence
GLVRILLRLLLRYGDGGGGSLVRILLRLLLRFG

SEQ ID NO: 2220 - protein, 33 aa, Artificial Sequence
  Antimicrobial peptide sequence
GLVRILLRLLLRYGDGGGGGLVRILLRLLLRYG

SEQ ID NO: 2221 - protein, 33 aa, Artificial Sequence
  Antimicrobial peptide sequence
GLVRILLRLLLRYGDGGGGGLAWILLRWLFFRG

SEQ ID NO: 2222 - protein, 33 aa, Artificial Sequence
  Antimicrobial peptide sequence
GLVRILLRLLLRYGDGGGGGLVRILLRWLFFRG

SEQ ID NO: 2223 - protein, 33 aa, Artificial Sequence
  Antimicrobial peptide sequence
GLVRILLRLLLRYGDGGGGGLLRILLRWLFFRG

SEQ ID NO: 2224 - protein, 33 aa, Artificial Sequence
  Antimicrobial peptide sequence
GLVRILLRLLLRYGDGGGGGLPWILLRWLFRFG

SEQ ID NO: 2225 - protein, 33 aa, Artificial Sequence
  Antimicrobial peptide sequence
GLVRILLRLLLRYGDGGGGGLLRILLRWLFRFG

SEQ ID NO: 2226 - protein, 33 aa, Artificial Sequence
  Antimicrobial peptide sequence
GLVRILLRLLLRYGDGGGGGLPWILLRWLFRRG

SEQ ID NO: 2227 - protein, 34 aa, Artificial Sequence
  Antimicrobial peptide sequence
GLVRILLRLLLRYGDGGGGGGLPWILLRWLFFRG

SEQ ID NO: 2228 - protein, 34 aa, Artificial Sequence
  Antimicrobial peptide sequence
GLVRILLRLLLRYGDGGGGGGLARILLRWLFFRG

SEQ ID NO: 2229 - protein, 34 aa, Artificial Sequence
  Antimicrobial peptide sequence
GLVRILLRLLLRYGDGGGGGGLARILLRWLFRFG

SEQ ID NO: 2230 - protein, 34 aa, Artificial Sequence
  Antimicrobial peptide sequence
GLVRILLRLLLRYGDGGGGGGLVRILLRWLFRFG

SEQ ID NO: 2231 - protein, 34 aa, Artificial Sequence
  Antimicrobial peptide sequence
GLVRILLRLLLRYGDGGGGGGLARILLRLLFFRG

SEQ ID NO: 2232 - protein, 34 aa, Artificial Sequence
  Antimicrobial peptide sequence
GLVRILLRLLLRYGDGGGGGGLARILLRLLFRFG

SEQ ID NO: 2233 - protein, 34 aa, Artificial Sequence
  Antimicrobial peptide sequence
GLVRILLRLLLRYGDGGGGGGLVRILLRLLFRFG

SEQ ID NO: 2234 - protein, 34 aa, Artificial Sequence
  Antimicrobial peptide sequence
GLVRILLRLLLRYGDGGGGGSLVRILLRLLLRFG

SEQ ID NO: 2235 - protein, 34 aa, Artificial Sequence
  Antimicrobial peptide sequence
GLVRILLRLLLRYGDGGGGGGLVRILLRLLLRYG

SEQ ID NO: 2236 - protein, 34 aa, Artificial Sequence
  Antimicrobial peptide sequence
GLVRILLRLLLRYGDGGGGGGLAWILLRWLFFRG

SEQ ID NO: 2237 - protein, 34 aa, Artificial Sequence
  Antimicrobial peptide sequence
GLVRILLRLLLRYGDGGGGGGLVRILLRWLFFRG

SEQ ID NO: 2238 - protein, 34 aa, Artificial Sequence
  Antimicrobial peptide sequence
GLVRILLRLLLRYGDGGGGGGLLRILLRWLFFRG

SEQ ID NO: 2239 - protein, 34 aa, Artificial Sequence
  Antimicrobial peptide sequence
GLVRILLRLLLRYGDGGGGGGLPWILLRWLFRFG

SEQ ID NO: 2240 - protein, 34 aa, Artificial Sequence
  Antimicrobial peptide sequence
GLVRILLRLLLRYGDGGGGGGLLRILLRWLFRFG

SEQ ID NO: 2241 - protein, 34 aa, Artificial Sequence
  Antimicrobial peptide sequence
GLVRILLRLLLRYGDGGGGGGLPWILLRWLFRRG

SEQ ID NO: 2242 - protein, 35 aa, Artificial Sequence
  Antimicrobial peptide sequence
GLVRILLRLLLRYGDGGGGGGGLPWILLRWLFFRG

SEQ ID NO: 2243 - protein, 35 aa, Artificial Sequence
  Antimicrobial peptide sequence
GLVRILLRLLLRYGDGGGGGGGLARILLRWLFFRG

SEQ ID NO: 2244 - protein, 35 aa, Artificial Sequence
  Antimicrobial peptide sequence
GLVRILLRLLLRYGDGGGGGGGLARILLRWLFRFG

SEQ ID NO: 2245 - protein, 35 aa, Artificial Sequence
  Antimicrobial peptide sequence
GLVRILLRLLLRYGDGGGGGGGLVRILLRWLFRFG

SEQ ID NO: 2246 - protein, 35 aa, Artificial Sequence
  Antimicrobial peptide sequence
GLVRILLRLLLRYGDGGGGGGGLARILLRLLFFRG

SEQ ID NO: 2247 - protein, 35 aa, Artificial Sequence
  Antimicrobial peptide sequence
GLVRILLRLLLRYGDGGGGGGGLARILLRLLFRFG

SEQ ID NO: 2248 - protein, 35 aa, Artificial Sequence
  Antimicrobial peptide sequence
GLVRILLRLLLRYGDGGGGGGGLVRILLRLLFRFG

SEQ ID NO: 2249 - protein, 35 aa, Artificial Sequence
  Antimicrobial peptide sequence
GLVRILLRLLLRYGDGGGGGGSLVRILLRLLLRFG

SEQ ID NO: 2250 - protein, 35 aa, Artificial Sequence
  Antimicrobial peptide sequence
GLVRILLRLLLRYGDGGGGGGGLVRILLRLLLRYG

SEQ ID NO: 2251 - protein, 35 aa, Artificial Sequence
  Antimicrobial peptide sequence
GLVRILLRLLLRYGDGGGGGGGLAWILLRWLFFRG

SEQ ID NO: 2252 - protein, 35 aa, Artificial Sequence
  Antimicrobial peptide sequence
GLVRILLRLLLRYGDGGGGGGGLVRILLRWLFFRG

SEQ ID NO: 2253 - protein, 35 aa, Artificial Sequence
  Antimicrobial peptide sequence
GLVRILLRLLLRYGDGGGGGGGLLRILLRWLFFRG

SEQ ID NO: 2254 - protein, 35 aa, Artificial Sequence
  Antimicrobial peptide sequence
GLVRILLRLLLRYGDGGGGGGGLPWILLRWLFRFG

SEQ ID NO: 2255 - protein, 35 aa, Artificial Sequence
  Antimicrobial peptide sequence
GLVRILLRLLLRYGDGGGGGGGLLRILLRWLFRFG

SEQ ID NO: 2256 - protein, 35 aa, Artificial Sequence
  Antimicrobial peptide sequence
GLVRILLRLLLRYGDGGGGGGGLPWILLRWLFRRG

SEQ ID NO: 2257 - protein, 36 aa, Artificial Sequence
  Antimicrobial peptide sequence
GLVRILLRLLLRYGDGGGGGGGGLPWILLRWLFFRG

SEQ ID NO: 2258 - protein, 36 aa, Artificial Sequence
  Antimicrobial peptide sequence
GLVRILLRLLLRYGDGGGGGGGGLARILLRWLFFRG

SEQ ID NO: 2259 - protein, 36 aa, Artificial Sequence
  Antimicrobial peptide sequence
GLVRILLRLLLRYGDGGGGGGGGLARILLRWLFRFG

SEQ ID NO: 2260 - protein, 36 aa, Artificial Sequence
  Antimicrobial peptide sequence
GLVRILLRLLLRYGDGGGGGGGGLVRILLRWLFRFG

SEQ ID NO: 2261 - protein, 36 aa, Artificial Sequence
  Antimicrobial peptide sequence
GLVRILLRLLLRYGDGGGGGGGGLARILLRLLFFRG

SEQ ID NO: 2262 - protein, 36 aa, Artificial Sequence
  Antimicrobial peptide sequence
GLVRILLRLLLRYGDGGGGGGGGLARILLRLLFRFG

SEQ ID NO: 2263 - protein, 36 aa, Artificial Sequence
  Antimicrobial peptide sequence
GLVRILLRLLLRYGDGGGGGGGGLVRILLRLLFRFG

SEQ ID NO: 2264 - protein, 36 aa, Artificial Sequence
  Antimicrobial peptide sequence
GLVRILLRLLLRYGDGGGGGGGSLVRILLRLLLRFG

SEQ ID NO: 2265 - protein, 36 aa, Artificial Sequence
  Antimicrobial peptide sequence
GLVRILLRLLLRYGDGGGGGGGGLVRILLRLLLRYG

SEQ ID NO: 2266 - protein, 36 aa, Artificial Sequence
  Antimicrobial peptide sequence
GLVRILLRLLLRYGDGGGGGGGGLAWILLRWLFFRG

SEQ ID NO: 2267 - protein, 36 aa, Artificial Sequence
  Antimicrobial peptide sequence
GLVRILLRLLLRYGDGGGGGGGGLVRILLRWLFFRG

SEQ ID NO: 2268 - protein, 36 aa, Artificial Sequence
  Antimicrobial peptide sequence
GLVRILLRLLLRYGDGGGGGGGGLLRILLRWLFFRG

SEQ ID NO: 2269 - protein, 36 aa, Artificial Sequence
  Antimicrobial peptide sequence
GLVRILLRLLLRYGDGGGGGGGGLPWILLRWLFRFG

SEQ ID NO: 2270 - protein, 36 aa, Artificial Sequence
  Antimicrobial peptide sequence
GLVRILLRLLLRYGDGGGGGGGGLLRILLRWLFRFG

SEQ ID NO: 2271 - protein, 36 aa, Artificial Sequence
  Antimicrobial peptide sequence
GLVRILLRLLLRYGDGGGGGGGGLPWILLRWLFRRG

SEQ ID NO: 2272 - protein, 33 aa, Artificial Sequence
  Antimicrobial peptide sequence
GLVRILLRLLLRYGDNNNNGLPWILLRWLFFRG

SEQ ID NO: 2273 - protein, 33 aa, Artificial Sequence
  Antimicrobial peptide sequence
GLVRILLRLLLRYGDNNNNGLARILLRWLFFRG

SEQ ID NO: 2274 - protein, 33 aa, Artificial Sequence
  Antimicrobial peptide sequence
GLVRILLRLLLRYGDNNNNGLARILLRWLFRFG

SEQ ID NO: 2275 - protein, 33 aa, Artificial Sequence
  Antimicrobial peptide sequence
GLVRILLRLLLRYGDNNNNGLVRILLRWLFRFG

SEQ ID NO: 2276 - protein, 33 aa, Artificial Sequence
  Antimicrobial peptide sequence
GLVRILLRLLLRYGDNNNNGLARILLRLLFFRG

SEQ ID NO: 2277 - protein, 33 aa, Artificial Sequence
  Antimicrobial peptide sequence
GLVRILLRLLLRYGDNNNNGLARILLRLLFRFG

SEQ ID NO: 2278 - protein, 33 aa, Artificial Sequence
  Antimicrobial peptide sequence
GLVRILLRLLLRYGDNNNNGLVRILLRLLFRFG

SEQ ID NO: 2279 - protein, 33 aa, Artificial Sequence
  Antimicrobial peptide sequence
GLVRILLRLLLRYGDNNNNSLVRILLRLLLRFG

SEQ ID NO: 2280 - protein, 33 aa, Artificial Sequence
  Antimicrobial peptide sequence
GLVRILLRLLLRYGDNNNNGLVRILLRLLLRYG

SEQ ID NO: 2281 - protein, 33 aa, Artificial Sequence
  Antimicrobial peptide sequence
GLVRILLRLLLRYGDNNNNGLAWILLRWLFFRG

SEQ ID NO: 2282 - protein, 33 aa, Artificial Sequence
  Antimicrobial peptide sequence
GLVRILLRLLLRYGDNNNNGLVRILLRWLFFRG

SEQ ID NO: 2283 - protein, 33 aa, Artificial Sequence
  Antimicrobial peptide sequence
GLVRILLRLLLRYGDNNNNGLLRILLRWLFFRG

SEQ ID NO: 2284 - protein, 33 aa, Artificial Sequence
  Antimicrobial peptide sequence
GLVRILLRLLLRYGDNNNNGLPWILLRWLFRFG

SEQ ID NO: 2285 - protein, 33 aa, Artificial Sequence
  Antimicrobial peptide sequence
GLVRILLRLLLRYGDNNNNGLLRILLRWLFRFG

SEQ ID NO: 2286 - protein, 33 aa, Artificial Sequence
  Antimicrobial peptide sequence
GLVRILLRLLLRYGDNNNNGLPWILLRWLFRRG

SEQ ID NO: 2287 - protein, 34 aa, Artificial Sequence
  Antimicrobial peptide sequence
GLVRILLRLLLRYGDNNNNNGLPWILLRWLFFRG

SEQ ID NO: 2288 - protein, 34 aa, Artificial Sequence
  Antimicrobial peptide sequence
GLVRILLRLLLRYGDNNNNNGLARILLRWLFFRG

SEQ ID NO: 2289 - protein, 34 aa, Artificial Sequence
  Antimicrobial peptide sequence
GLVRILLRLLLRYGDNNNNNGLARILLRWLFRFG

SEQ ID NO: 2290 - protein, 34 aa, Artificial Sequence
  Antimicrobial peptide sequence
GLVRILLRLLLRYGDNNNNNGLVRILLRWLFRFG

SEQ ID NO: 2291 - protein, 34 aa, Artificial Sequence
  Antimicrobial peptide sequence
GLVRILLRLLLRYGDNNNNNGLARILLRLLFFRG

SEQ ID NO: 2292 - protein, 34 aa, Artificial Sequence
  Antimicrobial peptide sequence
GLVRILLRLLLRYGDNNNNNGLARILLRLLFRFG

SEQ ID NO: 2293 - protein, 34 aa, Artificial Sequence
  Antimicrobial peptide sequence
GLVRILLRLLLRYGDNNNNNGLVRILLRLLFRFG

SEQ ID NO: 2294 - protein, 34 aa, Artificial Sequence
  Antimicrobial peptide sequence
GLVRILLRLLLRYGDNNNNNSLVRILLRLLLRFG

SEQ ID NO: 2295 - protein, 34 aa, Artificial Sequence
  Antimicrobial peptide sequence
GLVRILLRLLLRYGDNNNNNGLVRILLRLLLRYG

SEQ ID NO: 2296 - protein, 34 aa, Artificial Sequence
  Antimicrobial peptide sequence
GLVRILLRLLLRYGDNNNNNGLAWILLRWLFFRG

SEQ ID NO: 2297 - protein, 34 aa, Artificial Sequence
  Antimicrobial peptide sequence
GLVRILLRLLLRYGDNNNNNGLVRILLRWLFFRG

SEQ ID NO: 2298 - protein, 34 aa, Artificial Sequence
  Antimicrobial peptide sequence
GLVRILLRLLLRYGDNNNNNGLLRILLRWLFFRG

SEQ ID NO: 2299 - protein, 34 aa, Artificial Sequence
  Antimicrobial peptide sequence
GLVRILLRLLLRYGDNNNNNGLPWILLRWLFRFG

SEQ ID NO: 2300 - protein, 34 aa, Artificial Sequence
  Antimicrobial peptide sequence
GLVRILLRLLLRYGDNNNNNGLLRILLRWLFRFG

SEQ ID NO: 2301 - protein, 34 aa, Artificial Sequence
  Antimicrobial peptide sequence
GLVRILLRLLLRYGDNNNNNGLPWILLRWLFRRG

SEQ ID NO: 2302 - protein, 35 aa, Artificial Sequence
  Antimicrobial peptide sequence
GLVRILLRLLLRYGDNNNNNNGLPWILLRWLFFRG

SEQ ID NO: 2303 - protein, 35 aa, Artificial Sequence
  Antimicrobial peptide sequence
GLVRILLRLLLRYGDNNNNNNGLARILLRWLFFRG

SEQ ID NO: 2304 - protein, 35 aa, Artificial Sequence
  Antimicrobial peptide sequence
GLVRILLRLLLRYGDNNNNNNGLARILLRWLFRFG

SEQ ID NO: 2305 - protein, 35 aa, Artificial Sequence
  Antimicrobial peptide sequence
GLVRILLRLLLRYGDNNNNNNGLVRILLRWLFRFG

SEQ ID NO: 2306 - protein, 35 aa, Artificial Sequence
  Antimicrobial peptide sequence
GLVRILLRLLLRYGDNNNNNNGLARILLRLLFFRG

SEQ ID NO: 2307 - protein, 35 aa, Artificial Sequence
  Antimicrobial peptide sequence
GLVRILLRLLLRYGDNNNNNNGLARILLRLLFRFG

SEQ ID NO: 2308 - protein, 35 aa, Artificial Sequence
  Antimicrobial peptide sequence
GLVRILLRLLLRYGDNNNNNNGLVRILLRLLFRFG

SEQ ID NO: 2309 - protein, 35 aa, Artificial Sequence
  Antimicrobial peptide sequence
GLVRILLRLLLRYGDNNNNNNSLVRILLRLLLRFG

SEQ ID NO: 2310 - protein, 35 aa, Artificial Sequence
  Antimicrobial peptide sequence
GLVRILLRLLLRYGDNNNNNNGLVRILLRLLLRYG

SEQ ID NO: 2311 - protein, 35 aa, Artificial Sequence
  Antimicrobial peptide sequence
GLVRILLRLLLRYGDNNNNNNGLAWILLRWLFFRG

SEQ ID NO: 2312 - protein, 35 aa, Artificial Sequence
  Antimicrobial peptide sequence
GLVRILLRLLLRYGDNNNNNNGLVRILLRWLFFRG

SEQ ID NO: 2313 - protein, 35 aa, Artificial Sequence
  Antimicrobial peptide sequence
GLVRILLRLLLRYGDNNNNNNGLLRILLRWLFFRG

SEQ ID NO: 2314 - protein, 35 aa, Artificial Sequence
  Antimicrobial peptide sequence
GLVRILLRLLLRYGDNNNNNNGLPWILLRWLFRFG

SEQ ID NO: 2315 - protein, 35 aa, Artificial Sequence
  Antimicrobial peptide sequence
GLVRILLRLLLRYGDNNNNNNGLLRILLRWLFRFG

SEQ ID NO: 2316 - protein, 35 aa, Artificial Sequence
  Antimicrobial peptide sequence
GLVRILLRLLLRYGDNNNNNNGLPWILLRWLFRRG

SEQ ID NO: 2317 - protein, 36 aa, Artificial Sequence
  Antimicrobial peptide sequence
GLVRILLRLLLRYGDNNNNNNNGLPWILLRWLFFRG

SEQ ID NO: 2318 - protein, 36 aa, Artificial Sequence
  Antimicrobial peptide sequence
GLVRILLRLLLRYGDNNNNNNNGLARILLRWLFFRG

SEQ ID NO: 2319 - protein, 36 aa, Artificial Sequence
  Antimicrobial peptide sequence
GLVRILLRLLLRYGDNNNNNNNGLARILLRWLFRFG

SEQ ID NO: 2320 - protein, 36 aa, Artificial Sequence
  Antimicrobial peptide sequence
GLVRILLRLLLRYGDNNNNNNNGLVRILLRWLFRFG

SEQ ID NO: 2321 - protein, 36 aa, Artificial Sequence
  Antimicrobial peptide sequence
GLVRILLRLLLRYGDNNNNNNNGLARILLRLLFFRG

SEQ ID NO: 2322 - protein, 36 aa, Artificial Sequence
  Antimicrobial peptide sequence
GLVRILLRLLLRYGDNNNNNNNGLARILLRLLFRFG

SEQ ID NO: 2323 - protein, 36 aa, Artificial Sequence
  Antimicrobial peptide sequence
GLVRILLRLLLRYGDNNNNNNNGLVRILLRLLFRFG

SEQ ID NO: 2324 - protein, 36 aa, Artificial Sequence
  Antimicrobial peptide sequence
GLVRILLRLLLRYGDNNNNNNNSLVRILLRLLLRFG

SEQ ID NO: 2325 - protein, 36 aa, Artificial Sequence
  Antimicrobial peptide sequence
GLVRILLRLLLRYGDNNNNNNNGLVRILLRLLLRYG

SEQ ID NO: 2326 - protein, 36 aa, Artificial Sequence
  Antimicrobial peptide sequence
GLVRILLRLLLRYGDNNNNNNNGLAWILLRWLFFRG

SEQ ID NO: 2327 - protein, 36 aa, Artificial Sequence
  Antimicrobial peptide sequence
GLVRILLRLLLRYGDNNNNNNNGLVRILLRWLFFRG

SEQ ID NO: 2328 - protein, 36 aa, Artificial Sequence
  Antimicrobial peptide sequence
GLVRILLRLLLRYGDNNNNNNNGLLRILLRWLFFRG

SEQ ID NO: 2329 - protein, 36 aa, Artificial Sequence
  Antimicrobial peptide sequence
GLVRILLRLLLRYGDNNNNNNNGLPWILLRWLFRFG

SEQ ID NO: 2330 - protein, 36 aa, Artificial Sequence
  Antimicrobial peptide sequence
GLVRILLRLLLRYGDNNNNNNNGLLRILLRWLFRFG

SEQ ID NO: 2331 - protein, 36 aa, Artificial Sequence
  Antimicrobial peptide sequence
GLVRILLRLLLRYGDNNNNNNNGLPWILLRWLFRRG

SEQ ID NO: 2332 - protein, 35 aa, Artificial Sequence
  Antimicrobial peptide sequence
GLVRILLRLLLRYGDNGNGNGGLPWILLRWLFFRG

SEQ ID NO: 2333 - protein, 35 aa, Artificial Sequence
  Antimicrobial peptide sequence
GLVRILLRLLLRYGDNGNGNGGLARILLRWLFFRG

SEQ ID NO: 2334 - protein, 35 aa, Artificial Sequence
  Antimicrobial peptide sequence
GLVRILLRLLLRYGDNGNGNGGLARILLRWLFRFG

SEQ ID NO: 2335 - protein, 35 aa, Artificial Sequence
  Antimicrobial peptide sequence
GLVRILLRLLLRYGDNGNGNGGLVRILLRWLFRFG

SEQ ID NO: 2336 - protein, 35 aa, Artificial Sequence
  Antimicrobial peptide sequence
GLVRILLRLLLRYGDNGNGNGGLARILLRLLFFRG

SEQ ID NO: 2337 - protein, 35 aa, Artificial Sequence
  Antimicrobial peptide sequence
GLVRILLRLLLRYGDNGNGNGGLARILLRLLFRFG

SEQ ID NO: 2338 - protein, 35 aa, Artificial Sequence
  Antimicrobial peptide sequence
GLVRILLRLLLRYGDNGNGNGGLVRILLRLLFRFG

SEQ ID NO: 2339 - protein, 35 aa, Artificial Sequence
  Antimicrobial peptide sequence
GLVRILLRLLLRYGDNGNGNGSLVRILLRLLLRFG

SEQ ID NO: 2340 - protein, 35 aa, Artificial Sequence
  Antimicrobial peptide sequence
GLVRILLRLLLRYGDNGNGNGGLVRILLRLLLRYG

SEQ ID NO: 2341 - protein, 35 aa, Artificial Sequence
  Antimicrobial peptide sequence
GLVRILLRLLLRYGDNGNGNGGLAWILLRWLFFRG

SEQ ID NO: 2342 - protein, 35 aa, Artificial Sequence
  Antimicrobial peptide sequence
GLVRILLRLLLRYGDNGNGNGGLVRILLRWLFFRG

SEQ ID NO: 2343 - protein, 35 aa, Artificial Sequence
  Antimicrobial peptide sequence
GLVRILLRLLLRYGDNGNGNGGLLRILLRWLFFRG

SEQ ID NO: 2344 - protein, 35 aa, Artificial Sequence
  Antimicrobial peptide sequence
GLVRILLRLLLRYGDNGNGNGGLPWILLRWLFRFG

SEQ ID NO: 2345 - protein, 35 aa, Artificial Sequence
  Antimicrobial peptide sequence
GLVRILLRLLLRYGDNGNGNGGLLRILLRWLFRFG

SEQ ID NO: 2346 - protein, 35 aa, Artificial Sequence
  Antimicrobial peptide sequence
GLVRILLRLLLRYGDNGNGNGGLPWILLRWLFRRG

SEQ ID NO: 2347 - protein, 35 aa, Artificial Sequence
  Antimicrobial peptide sequence
GLVRILLRLLLRYGDGNGNGNGLPWILLRWLFFRG

SEQ ID NO: 2348 - protein, 35 aa, Artificial Sequence
  Antimicrobial peptide sequence
GLVRILLRLLLRYGDGNGNGNGLARILLRWLFFRG

SEQ ID NO: 2349 - protein, 35 aa, Artificial Sequence
  Antimicrobial peptide sequence
GLVRILLRLLLRYGDGNGNGNGLARILLRWLFRFG

SEQ ID NO: 2350 - protein, 35 aa, Artificial Sequence
  Antimicrobial peptide sequence
GLVRILLRLLLRYGDGNGNGNGLVRILLRWLFRFG

SEQ ID NO: 2351 - protein, 35 aa, Artificial Sequence
  Antimicrobial peptide sequence
GLVRILLRLLLRYGDGNGNGNGLARILLRLLFFRG

SEQ ID NO: 2352 - protein, 35 aa, Artificial Sequence
  Antimicrobial peptide sequence
GLVRILLRLLLRYGDGNGNGNGLARILLRLLFRFG

SEQ ID NO: 2353 - protein, 35 aa, Artificial Sequence
  Antimicrobial peptide sequence
GLVRILLRLLLRYGDGNGNGNGLVRILLRLLFRFG

SEQ ID NO: 2354 - protein, 35 aa, Artificial Sequence
  Antimicrobial peptide sequence
GLVRILLRLLLRYGDGNGNGNSLVRILLRLLLRFG

SEQ ID NO: 2355 - protein, 35 aa, Artificial Sequence
  Antimicrobial peptide sequence
GLVRILLRLLLRYGDGNGNGNGLVRILLRLLLRYG

SEQ ID NO: 2356 - protein, 35 aa, Artificial Sequence
  Antimicrobial peptide sequence
GLVRILLRLLLRYGDGNGNGNGLAWILLRWLFFRG

SEQ ID NO: 2357 - protein, 35 aa, Artificial Sequence
  Antimicrobial peptide sequence
GLVRILLRLLLRYGDGNGNGNGLVRILLRWLFFRG

SEQ ID NO: 2358 - protein, 35 aa, Artificial Sequence
  Antimicrobial peptide sequence
GLVRILLRLLLRYGDGNGNGNGLLRILLRWLFFRG

SEQ ID NO: 2359 - protein, 35 aa, Artificial Sequence
  Antimicrobial peptide sequence
GLVRILLRLLLRYGDGNGNGNGLPWILLRWLFRFG

SEQ ID NO: 2360 - protein, 35 aa, Artificial Sequence
  Antimicrobial peptide sequence
GLVRILLRLLLRYGDGNGNGNGLLRILLRWLFRFG

SEQ ID NO: 2361 - protein, 35 aa, Artificial Sequence
  Antimicrobial peptide sequence
GLVRILLRLLLRYGDGNGNGNGLPWILLRWLFRRG

SEQ ID NO: 2362 - protein, 35 aa, Artificial Sequence
  Antimicrobial peptide sequence
GLVRILLRLLLRYGDSGSGSGGLPWILLRWLFFRG

SEQ ID NO: 2363 - protein, 35 aa, Artificial Sequence
  Antimicrobial peptide sequence
GLVRILLRLLLRYGDSGSGSGGLARILLRWLFFRG

SEQ ID NO: 2364 - protein, 35 aa, Artificial Sequence
  Antimicrobial peptide sequence
GLVRILLRLLLRYGDSGSGSGGLARILLRWLFRFG

SEQ ID NO: 2365 - protein, 35 aa, Artificial Sequence
  Antimicrobial peptide sequence
GLVRILLRLLLRYGDSGSGSGGLVRILLRWLFRFG

SEQ ID NO: 2366 - protein, 35 aa, Artificial Sequence
  Antimicrobial peptide sequence
GLVRILLRLLLRYGDSGSGSGGLARILLRLLFFRG

SEQ ID NO: 2367 - protein, 35 aa, Artificial Sequence
  Antimicrobial peptide sequence
GLVRILLRLLLRYGDSGSGSGGLARILLRLLFRFG

SEQ ID NO: 2368 - protein, 35 aa, Artificial Sequence
  Antimicrobial peptide sequence
GLVRILLRLLLRYGDSGSGSGGLVRILLRLLFRFG

SEQ ID NO: 2369 - protein, 35 aa, Artificial Sequence
  Antimicrobial peptide sequence
GLVRILLRLLLRYGDSGSGSGSLVRILLRLLLRFG

SEQ ID NO: 2370 - protein, 35 aa, Artificial Sequence
  Antimicrobial peptide sequence
GLVRILLRLLLRYGDSGSGSGGLVRILLRLLLRYG

SEQ ID NO: 2371 - protein, 35 aa, Artificial Sequence
  Antimicrobial peptide sequence
GLVRILLRLLLRYGDSGSGSGGLAWILLRWLFFRG

SEQ ID NO: 2372 - protein, 35 aa, Artificial Sequence
  Antimicrobial peptide sequence
GLVRILLRLLLRYGDSGSGSGGLVRILLRWLFFRG

SEQ ID NO: 2373 - protein, 35 aa, Artificial Sequence
  Antimicrobial peptide sequence
GLVRILLRLLLRYGDSGSGSGGLLRILLRWLFFRG

SEQ ID NO: 2374 - protein, 35 aa, Artificial Sequence
  Antimicrobial peptide sequence
GLVRILLRLLLRYGDSGSGSGGLPWILLRWLFRFG

SEQ ID NO: 2375 - protein, 35 aa, Artificial Sequence
  Antimicrobial peptide sequence
GLVRILLRLLLRYGDSGSGSGGLLRILLRWLFRFG

SEQ ID NO: 2376 - protein, 35 aa, Artificial Sequence
  Antimicrobial peptide sequence
GLVRILLRLLLRYGDSGSGSGGLPWILLRWLFRRG

SEQ ID NO: 2377 - protein, 35 aa, Artificial Sequence
  Antimicrobial peptide sequence
GLVRILLRLLLRYGDGSGSGSGLPWILLRWLFFRG

SEQ ID NO: 2378 - protein, 35 aa, Artificial Sequence
  Antimicrobial peptide sequence
GLVRILLRLLLRYGDGSGSGSGLARILLRWLFFRG

SEQ ID NO: 2379 - protein, 35 aa, Artificial Sequence
  Antimicrobial peptide sequence
GLVRILLRLLLRYGDGSGSGSGLARILLRWLFRFG

SEQ ID NO: 2380 - protein, 35 aa, Artificial Sequence
  Antimicrobial peptide sequence
GLVRILLRLLLRYGDGSGSGSGLVRILLRWLFRFG

SEQ ID NO: 2381 - protein, 35 aa, Artificial Sequence
  Antimicrobial peptide sequence
GLVRILLRLLLRYGDGSGSGSGLARILLRLLFFRG

SEQ ID NO: 2382 - protein, 35 aa, Artificial Sequence
  Antimicrobial peptide sequence
GLVRILLRLLLRYGDGSGSGSGLARILLRLLFRFG

SEQ ID NO: 2383 - protein, 35 aa, Artificial Sequence
  Antimicrobial peptide sequence
GLVRILLRLLLRYGDGSGSGSGLVRILLRLLFRFG

SEQ ID NO: 2384 - protein, 35 aa, Artificial Sequence
  Antimicrobial peptide sequence
GLVRILLRLLLRYGDGSGSGSSLVRILLRLLLRFG

SEQ ID NO: 2385 - protein, 35 aa, Artificial Sequence
  Antimicrobial peptide sequence
GLVRILLRLLLRYGDGSGSGSGLVRILLRLLLRYG

SEQ ID NO: 2386 - protein, 35 aa, Artificial Sequence
  Antimicrobial peptide sequence
GLVRILLRLLLRYGDGSGSGSGLAWILLRWLFFRG

SEQ ID NO: 2387 - protein, 35 aa, Artificial Sequence
  Antimicrobial peptide sequence
GLVRILLRLLLRYGDGSGSGSGLVRILLRWLFFRG

SEQ ID NO: 2388 - protein, 35 aa, Artificial Sequence
  Antimicrobial peptide sequence
GLVRILLRLLLRYGDGSGSGSGLLRILLRWLFFRG

SEQ ID NO: 2389 - protein, 35 aa, Artificial Sequence
  Antimicrobial peptide sequence
GLVRILLRLLLRYGDGSGSGSGLPWILLRWLFRFG

SEQ ID NO: 2390 - protein, 35 aa, Artificial Sequence
  Antimicrobial peptide sequence
GLVRILLRLLLRYGDGSGSGSGLLRILLRWLFRFG

SEQ ID NO: 2391 - protein, 35 aa, Artificial Sequence
  Antimicrobial peptide sequence
GLVRILLRLLLRYGDGSGSGSGLPWILLRWLFRRG

SEQ ID NO: 2392 - protein, 35 aa, Artificial Sequence
  Antimicrobial peptide sequence
GLVRILLRLLLRYGDSNSNSNGLPWILLRWLFFRG

SEQ ID NO: 2393 - protein, 35 aa, Artificial Sequence
  Antimicrobial peptide sequence
GLVRILLRLLLRYGDSNSNSNGLARILLRWLFFRG

SEQ ID NO: 2394 - protein, 35 aa, Artificial Sequence
  Antimicrobial peptide sequence
GLVRILLRLLLRYGDSNSNSNGLARILLRWLFRFG

SEQ ID NO: 2395 - protein, 35 aa, Artificial Sequence
  Antimicrobial peptide sequence
GLVRILLRLLLRYGDSNSNSNGLVRILLRWLFRFG

SEQ ID NO: 2396 - protein, 35 aa, Artificial Sequence
  Antimicrobial peptide sequence
GLVRILLRLLLRYGDSNSNSNGLARILLRLLFFRG

SEQ ID NO: 2397 - protein, 35 aa, Artificial Sequence
  Antimicrobial peptide sequence
GLVRILLRLLLRYGDSNSNSNGLARILLRLLFRFG

SEQ ID NO: 2398 - protein, 35 aa, Artificial Sequence
  Antimicrobial peptide sequence
GLVRILLRLLLRYGDSNSNSNGLVRILLRLLFRFG

SEQ ID NO: 2399 - protein, 35 aa, Artificial Sequence
  Antimicrobial peptide sequence
GLVRILLRLLLRYGDSNSNSNSLVRILLRLLLRFG

SEQ ID NO: 2400 - protein, 35 aa, Artificial Sequence
  Antimicrobial peptide sequence
GLVRILLRLLLRYGDSNSNSNGLVRILLRLLLRYG

SEQ ID NO: 2401 - protein, 35 aa, Artificial Sequence
  Antimicrobial peptide sequence
GLVRILLRLLLRYGDSNSNSNGLAWILLRWLFFRG

SEQ ID NO: 2402 - protein, 35 aa, Artificial Sequence
  Antimicrobial peptide sequence
GLVRILLRLLLRYGDSNSNSNGLVRILLRWLFFRG

SEQ ID NO: 2403 - protein, 35 aa, Artificial Sequence
  Antimicrobial peptide sequence
GLVRILLRLLLRYGDSNSNSNGLLRILLRWLFFRG

SEQ ID NO: 2404 - protein, 35 aa, Artificial Sequence
  Antimicrobial peptide sequence
GLVRILLRLLLRYGDSNSNSNGLPWILLRWLFRFG

SEQ ID NO: 2405 - protein, 35 aa, Artificial Sequence
  Antimicrobial peptide sequence
GLVRILLRLLLRYGDSNSNSNGLLRILLRWLFRFG

SEQ ID NO: 2406 - protein, 35 aa, Artificial Sequence
  Antimicrobial peptide sequence
GLVRILLRLLLRYGDSNSNSNGLPWILLRWLFRRG

SEQ ID NO: 2407 - protein, 35 aa, Artificial Sequence
  Antimicrobial peptide sequence
GLVRILLRLLLRYGDNSNSNSGLPWILLRWLFFRG

SEQ ID NO: 2408 - protein, 35 aa, Artificial Sequence
  Antimicrobial peptide sequence
GLVRILLRLLLRYGDNSNSNSGLARILLRWLFFRG

SEQ ID NO: 2409 - protein, 35 aa, Artificial Sequence
  Antimicrobial peptide sequence
GLVRILLRLLLRYGDNSNSNSGLARILLRWLFRFG

SEQ ID NO: 2410 - protein, 35 aa, Artificial Sequence
  Antimicrobial peptide sequence
GLVRILLRLLLRYGDNSNSNSGLVRILLRWLFRFG

SEQ ID NO: 2411 - protein, 35 aa, Artificial Sequence
  Antimicrobial peptide sequence
GLVRILLRLLLRYGDNSNSNSGLARILLRLLFFRG

SEQ ID NO: 2412 - protein, 35 aa, Artificial Sequence
  Antimicrobial peptide sequence
GLVRILLRLLLRYGDNSNSNSGLARILLRLLFRFG

SEQ ID NO: 2413 - protein, 35 aa, Artificial Sequence
  Antimicrobial peptide sequence
GLVRILLRLLLRYGDNSNSNSGLVRILLRLLFRFG

SEQ ID NO: 2414 - protein, 35 aa, Artificial Sequence
  Antimicrobial peptide sequence
GLVRILLRLLLRYGDNSNSNSSLVRILLRLLLRFG

SEQ ID NO: 2415 - protein, 35 aa, Artificial Sequence
  Antimicrobial peptide sequence
GLVRILLRLLLRYGDNSNSNSGLVRILLRLLLRYG

SEQ ID NO: 2416 - protein, 35 aa, Artificial Sequence
  Antimicrobial peptide sequence
GLVRILLRLLLRYGDNSNSNSGLAWILLRWLFFRG

SEQ ID NO: 2417 - protein, 35 aa, Artificial Sequence
  Antimicrobial peptide sequence
GLVRILLRLLLRYGDNSNSNSGLVRILLRWLFFRG

SEQ ID NO: 2418 - protein, 35 aa, Artificial Sequence
  Antimicrobial peptide sequence
GLVRILLRLLLRYGDNSNSNSGLLRILLRWLFFRG

SEQ ID NO: 2419 - protein, 35 aa, Artificial Sequence
  Antimicrobial peptide sequence
GLVRILLRLLLRYGDNSNSNSGLPWILLRWLFRFG

SEQ ID NO: 2420 - protein, 35 aa, Artificial Sequence
  Antimicrobial peptide sequence
GLVRILLRLLLRYGDNSNSNSGLLRILLRWLFRFG

SEQ ID NO: 2421 - protein, 35 aa, Artificial Sequence
  Antimicrobial peptide sequence
GLVRILLRLLLRYGDNSNSNSGLPWILLRWLFRRG

SEQ ID NO: 2422 - protein, 35 aa, Artificial Sequence
  Antimicrobial peptide sequence
GLVRILLRLLLRYGDHGHGHGGLPWILLRWLFFRG

SEQ ID NO: 2423 - protein, 35 aa, Artificial Sequence
  Antimicrobial peptide sequence
GLVRILLRLLLRYGDHGHGHGGLARILLRWLFFRG

SEQ ID NO: 2424 - protein, 35 aa, Artificial Sequence
  Antimicrobial peptide sequence
GLVRILLRLLLRYGDHGHGHGGLARILLRWLFRFG

SEQ ID NO: 2425 - protein, 35 aa, Artificial Sequence
  Antimicrobial peptide sequence
GLVRILLRLLLRYGDHGHGHGGLVRILLRWLFRFG

SEQ ID NO: 2426 - protein, 35 aa, Artificial Sequence
  Antimicrobial peptide sequence
GLVRILLRLLLRYGDHGHGHGGLARILLRLLFFRG

SEQ ID NO: 2427 - protein, 35 aa, Artificial Sequence
  Antimicrobial peptide sequence
GLVRILLRLLLRYGDHGHGHGGLARILLRLLFRFG

SEQ ID NO: 2428 - protein, 35 aa, Artificial Sequence
  Antimicrobial peptide sequence
GLVRILLRLLLRYGDHGHGHGGLVRILLRLLFRFG

SEQ ID NO: 2429 - protein, 35 aa, Artificial Sequence
  Antimicrobial peptide sequence
GLVRILLRLLLRYGDHGHGHGSLVRILLRLLLRFG

SEQ ID NO: 2430 - protein, 35 aa, Artificial Sequence
  Antimicrobial peptide sequence
GLVRILLRLLLRYGDHGHGHGGLVRILLRLLLRYG

SEQ ID NO: 2431 - protein, 35 aa, Artificial Sequence
  Antimicrobial peptide sequence
GLVRILLRLLLRYGDHGHGHGGLAWILLRWLFFRG

SEQ ID NO: 2432 - protein, 35 aa, Artificial Sequence
  Antimicrobial peptide sequence
GLVRILLRLLLRYGDHGHGHGGLVRILLRWLFFRG

SEQ ID NO: 2433 - protein, 35 aa, Artificial Sequence
  Antimicrobial peptide sequence
GLVRILLRLLLRYGDHGHGHGGLLRILLRWLFFRG

SEQ ID NO: 2434 - protein, 35 aa, Artificial Sequence
  Antimicrobial peptide sequence
GLVRILLRLLLRYGDHGHGHGGLPWILLRWLFRFG

SEQ ID NO: 2435 - protein, 35 aa, Artificial Sequence
  Antimicrobial peptide sequence
GLVRILLRLLLRYGDHGHGHGGLLRILLRWLFRFG

SEQ ID NO: 2436 - protein, 35 aa, Artificial Sequence
  Antimicrobial peptide sequence
GLVRILLRLLLRYGDHGHGHGGLPWILLRWLFRRG

SEQ ID NO: 2437 - protein, 35 aa, Artificial Sequence
  Antimicrobial peptide sequence
GLVRILLRLLLRYGDGHGHGHGLPWILLRWLFFRG

SEQ ID NO: 2438 - protein, 35 aa, Artificial Sequence
  Antimicrobial peptide sequence
GLVRILLRLLLRYGDGHGHGHGLARILLRWLFFRG

SEQ ID NO: 2439 - protein, 35 aa, Artificial Sequence
  Antimicrobial peptide sequence
GLVRILLRLLLRYGDGHGHGHGLARILLRWLFRFG

SEQ ID NO: 2440 - protein, 35 aa, Artificial Sequence
  Antimicrobial peptide sequence
GLVRILLRLLLRYGDGHGHGHGLVRILLRWLFRFG

SEQ ID NO: 2441 - protein, 35 aa, Artificial Sequence
  Antimicrobial peptide sequence
GLVRILLRLLLRYGDGHGHGHGLARILLRLLFFRG

SEQ ID NO: 2442 - protein, 35 aa, Artificial Sequence
  Antimicrobial peptide sequence
GLVRILLRLLLRYGDGHGHGHGLARILLRLLFRFG

SEQ ID NO: 2443 - protein, 35 aa, Artificial Sequence
  Antimicrobial peptide sequence
GLVRILLRLLLRYGDGHGHGHGLVRILLRLLFRFG

SEQ ID NO: 2444 - protein, 35 aa, Artificial Sequence
  Antimicrobial peptide sequence
GLVRILLRLLLRYGDGHGHGHSLVRILLRLLLRFG

SEQ ID NO: 2445 - protein, 35 aa, Artificial Sequence
  Antimicrobial peptide sequence
GLVRILLRLLLRYGDGHGHGHGLVRILLRLLLRYG

SEQ ID NO: 2446 - protein, 35 aa, Artificial Sequence
  Antimicrobial peptide sequence
GLVRILLRLLLRYGDGHGHGHGLAWILLRWLFFRG

SEQ ID NO: 2447 - protein, 35 aa, Artificial Sequence
  Antimicrobial peptide sequence
GLVRILLRLLLRYGDGHGHGHGLVRILLRWLFFRG

SEQ ID NO: 2448 - protein, 35 aa, Artificial Sequence
  Antimicrobial peptide sequence
GLVRILLRLLLRYGDGHGHGHGLLRILLRWLFFRG

SEQ ID NO: 2449 - protein, 35 aa, Artificial Sequence
  Antimicrobial peptide sequence
GLVRILLRLLLRYGDGHGHGHGLPWILLRWLFRFG

SEQ ID NO: 2450 - protein, 35 aa, Artificial Sequence
  Antimicrobial peptide sequence
GLVRILLRLLLRYGDGHGHGHGLLRILLRWLFRFG

SEQ ID NO: 2451 - protein, 35 aa, Artificial Sequence
  Antimicrobial peptide sequence
GLVRILLRLLLRYGDGHGHGHGLPWILLRWLFRRG

SEQ ID NO: 2452 - protein, 35 aa, Artificial Sequence
  Antimicrobial peptide sequence
GLVRILLRLLLRYGDHNHNHNGLPWILLRWLFFRG

SEQ ID NO: 2453 - protein, 35 aa, Artificial Sequence
  Antimicrobial peptide sequence
GLVRILLRLLLRYGDHNHNHNGLARILLRWLFFRG

SEQ ID NO: 2454 - protein, 35 aa, Artificial Sequence
  Antimicrobial peptide sequence
GLVRILLRLLLRYGDHNHNHNGLARILLRWLFRFG

SEQ ID NO: 2455 - protein, 35 aa, Artificial Sequence
  Antimicrobial peptide sequence
GLVRILLRLLLRYGDHNHNHNGLVRILLRWLFRFG

SEQ ID NO: 2456 - protein, 35 aa, Artificial Sequence
  Antimicrobial peptide sequence
GLVRILLRLLLRYGDHNHNHNGLARILLRLLFFRG

SEQ ID NO: 2457 - protein, 35 aa, Artificial Sequence
  Antimicrobial peptide sequence
GLVRILLRLLLRYGDHNHNHNGLARILLRLLFRFG

SEQ ID NO: 2458 - protein, 35 aa, Artificial Sequence
  Antimicrobial peptide sequence
GLVRILLRLLLRYGDHNHNHNGLVRILLRLLFRFG

SEQ ID NO: 2459 - protein, 35 aa, Artificial Sequence
  Antimicrobial peptide sequence
GLVRILLRLLLRYGDHNHNHNSLVRILLRLLLRFG

SEQ ID NO: 2460 - protein, 35 aa, Artificial Sequence
  Antimicrobial peptide sequence
GLVRILLRLLLRYGDHNHNHNGLVRILLRLLLRYG

SEQ ID NO: 2461 - protein, 35 aa, Artificial Sequence
  Antimicrobial peptide sequence
GLVRILLRLLLRYGDHNHNHNGLAWILLRWLFFRG

SEQ ID NO: 2462 - protein, 35 aa, Artificial Sequence
  Antimicrobial peptide sequence
GLVRILLRLLLRYGDHNHNHNGLVRILLRWLFFRG

SEQ ID NO: 2463 - protein, 35 aa, Artificial Sequence
  Antimicrobial peptide sequence
GLVRILLRLLLRYGDHNHNHNGLLRILLRWLFFRG

SEQ ID NO: 2464 - protein, 35 aa, Artificial Sequence
  Antimicrobial peptide sequence
GLVRILLRLLLRYGDHNHNHNGLPWILLRWLFRFG

SEQ ID NO: 2465 - protein, 35 aa, Artificial Sequence
  Antimicrobial peptide sequence
GLVRILLRLLLRYGDHNHNHNGLLRILLRWLFRFG

SEQ ID NO: 2466 - protein, 35 aa, Artificial Sequence
  Antimicrobial peptide sequence
GLVRILLRLLLRYGDHNHNHNGLPWILLRWLFRRG

SEQ ID NO: 2467 - protein, 35 aa, Artificial Sequence
  Antimicrobial peptide sequence
GLVRILLRLLLRYGDNHNHNHGLPWILLRWLFFRG

SEQ ID NO: 2468 - protein, 35 aa, Artificial Sequence
  Antimicrobial peptide sequence
GLVRILLRLLLRYGDNHNHNHGLARILLRWLFFRG

SEQ ID NO: 2469 - protein, 35 aa, Artificial Sequence
  Antimicrobial peptide sequence
GLVRILLRLLLRYGDNHNHNHGLARILLRWLFRFG

SEQ ID NO: 2470 - protein, 35 aa, Artificial Sequence
  Antimicrobial peptide sequence
GLVRILLRLLLRYGDNHNHNHGLVRILLRWLFRFG

SEQ ID NO: 2471 - protein, 35 aa, Artificial Sequence
  Antimicrobial peptide sequence
GLVRILLRLLLRYGDNHNHNHGLARILLRLLFFRG

SEQ ID NO: 2472 - protein, 35 aa, Artificial Sequence
  Antimicrobial peptide sequence
GLVRILLRLLLRYGDNHNHNHGLARILLRLLFRFG

SEQ ID NO: 2473 - protein, 35 aa, Artificial Sequence
  Antimicrobial peptide sequence
GLVRILLRLLLRYGDNHNHNHGLVRILLRLLFRFG

SEQ ID NO: 2474 - protein, 35 aa, Artificial Sequence
  Antimicrobial peptide sequence
GLVRILLRLLLRYGDNHNHNHSLVRILLRLLLRFG

SEQ ID NO: 2475 - protein, 35 aa, Artificial Sequence
  Antimicrobial peptide sequence
GLVRILLRLLLRYGDNHNHNHGLVRILLRLLLRYG

SEQ ID NO: 2476 - protein, 35 aa, Artificial Sequence
  Antimicrobial peptide sequence
GLVRILLRLLLRYGDNHNHNHGLAWILLRWLFFRG

SEQ ID NO: 2477 - protein, 35 aa, Artificial Sequence
  Antimicrobial peptide sequence
GLVRILLRLLLRYGDNHNHNHGLVRILLRWLFFRG

SEQ ID NO: 2478 - protein, 35 aa, Artificial Sequence
  Antimicrobial peptide sequence
GLVRILLRLLLRYGDNHNHNHGLLRILLRWLFFRG

SEQ ID NO: 2479 - protein, 35 aa, Artificial Sequence
  Antimicrobial peptide sequence
GLVRILLRLLLRYGDNHNHNHGLPWILLRWLFRFG

SEQ ID NO: 2480 - protein, 35 aa, Artificial Sequence
  Antimicrobial peptide sequence
GLVRILLRLLLRYGDNHNHNHGLLRILLRWLFRFG

SEQ ID NO: 2481 - protein, 35 aa, Artificial Sequence
  Antimicrobial peptide sequence
GLVRILLRLLLRYGDNHNHNHGLPWILLRWLFRRG

SEQ ID NO: 2482 - protein, 33 aa, Artificial Sequence
  Antimicrobial peptide sequence
GLAWILLRWLFFRGDGGGGGLPWILLRWLFFRG

SEQ ID NO: 2483 - protein, 33 aa, Artificial Sequence
  Antimicrobial peptide sequence
GLAWILLRWLFFRGDGGGGGLARILLRWLFFRG

SEQ ID NO: 2484 - protein, 33 aa, Artificial Sequence
  Antimicrobial peptide sequence
GLAWILLRWLFFRGDGGGGGLARILLRWLFRFG

SEQ ID NO: 2485 - protein, 33 aa, Artificial Sequence
  Antimicrobial peptide sequence
GLAWILLRWLFFRGDGGGGGLVRILLRWLFRFG

SEQ ID NO: 2486 - protein, 33 aa, Artificial Sequence
  Antimicrobial peptide sequence
GLAWILLRWLFFRGDGGGGGLARILLRLLFFRG

SEQ ID NO: 2487 - protein, 33 aa, Artificial Sequence
  Antimicrobial peptide sequence
GLAWILLRWLFFRGDGGGGGLARILLRLLFRFG

SEQ ID NO: 2488 - protein, 33 aa, Artificial Sequence
  Antimicrobial peptide sequence
GLAWILLRWLFFRGDGGGGGLVRILLRLLFRFG

SEQ ID NO: 2489 - protein, 33 aa, Artificial Sequence
  Antimicrobial peptide sequence
GLAWILLRWLFFRGDGGGGSLVRILLRLLLRFG

SEQ ID NO: 2490 - protein, 33 aa, Artificial Sequence
  Antimicrobial peptide sequence
GLAWILLRWLFFRGDGGGGGLVRILLRLLLRYG

SEQ ID NO: 2491 - protein, 33 aa, Artificial Sequence
  Antimicrobial peptide sequence
GLAWILLRWLFFRGDGGGGGLAWILLRWLFFRG

SEQ ID NO: 2492 - protein, 33 aa, Artificial Sequence
  Antimicrobial peptide sequence
GLAWILLRWLFFRGDGGGGGLVRILLRWLFFRG

SEQ ID NO: 2493 - protein, 33 aa, Artificial Sequence
  Antimicrobial peptide sequence
GLAWILLRWLFFRGDGGGGGLLRILLRWLFFRG

SEQ ID NO: 2494 - protein, 33 aa, Artificial Sequence
  Antimicrobial peptide sequence
GLAWILLRWLFFRGDGGGGGLPWILLRWLFRFG

SEQ ID NO: 2495 - protein, 33 aa, Artificial Sequence
  Antimicrobial peptide sequence
GLAWILLRWLFFRGDGGGGGLLRILLRWLFRFG

SEQ ID NO: 2496 - protein, 33 aa, Artificial Sequence
  Antimicrobial peptide sequence
GLAWILLRWLFFRGDGGGGGLPWILLRWLFRRG

SEQ ID NO: 2497 - protein, 34 aa, Artificial Sequence
  Antimicrobial peptide sequence
GLAWILLRWLFFRGDGGGGGGLPWILLRWLFFRG

SEQ ID NO: 2498 - protein, 34 aa, Artificial Sequence
  Antimicrobial peptide sequence
GLAWILLRWLFFRGDGGGGGGLARILLRWLFFRG

SEQ ID NO: 2499 - protein, 34 aa, Artificial Sequence
  Antimicrobial peptide sequence
GLAWILLRWLFFRGDGGGGGGLARILLRWLFRFG

SEQ ID NO: 2500 - protein, 34 aa, Artificial Sequence
  Antimicrobial peptide sequence
GLAWILLRWLFFRGDGGGGGGLVRILLRWLFRFG

SEQ ID NO: 2501 - protein, 34 aa, Artificial Sequence
  Antimicrobial peptide sequence
GLAWILLRWLFFRGDGGGGGGLARILLRLLFFRG

SEQ ID NO: 2502 - protein, 34 aa, Artificial Sequence
  Antimicrobial peptide sequence
GLAWILLRWLFFRGDGGGGGGLARILLRLLFRFG

SEQ ID NO: 2503 - protein, 34 aa, Artificial Sequence
  Antimicrobial peptide sequence
GLAWILLRWLFFRGDGGGGGGLVRILLRLLFRFG

SEQ ID NO: 2504 - protein, 34 aa, Artificial Sequence
  Antimicrobial peptide sequence
GLAWILLRWLFFRGDGGGGGSLVRILLRLLLRFG

SEQ ID NO: 2505 - protein, 34 aa, Artificial Sequence
  Antimicrobial peptide sequence
GLAWILLRWLFFRGDGGGGGGLVRILLRLLLRYG

SEQ ID NO: 2506 - protein, 34 aa, Artificial Sequence
  Antimicrobial peptide sequence
GLAWILLRWLFFRGDGGGGGGLAWILLRWLFFRG

SEQ ID NO: 2507 - protein, 34 aa, Artificial Sequence
  Antimicrobial peptide sequence
GLAWILLRWLFFRGDGGGGGGLVRILLRWLFFRG

SEQ ID NO: 2508 - protein, 34 aa, Artificial Sequence
  Antimicrobial peptide sequence
GLAWILLRWLFFRGDGGGGGGLLRILLRWLFFRG

SEQ ID NO: 2509 - protein, 34 aa, Artificial Sequence
  Antimicrobial peptide sequence
GLAWILLRWLFFRGDGGGGGGLPWILLRWLFRFG

SEQ ID NO: 2510 - protein, 34 aa, Artificial Sequence
  Antimicrobial peptide sequence
GLAWILLRWLFFRGDGGGGGGLLRILLRWLFRFG

SEQ ID NO: 2511 - protein, 34 aa, Artificial Sequence
  Antimicrobial peptide sequence
GLAWILLRWLFFRGDGGGGGGLPWILLRWLFRRG

SEQ ID NO: 2512 - protein, 35 aa, Artificial Sequence
  Antimicrobial peptide sequence
GLAWILLRWLFFRGDGGGGGGGLPWILLRWLFFRG

SEQ ID NO: 2513 - protein, 35 aa, Artificial Sequence
  Antimicrobial peptide sequence
GLAWILLRWLFFRGDGGGGGGGLARILLRWLFFRG

SEQ ID NO: 2514 - protein, 35 aa, Artificial Sequence
  Antimicrobial peptide sequence
GLAWILLRWLFFRGDGGGGGGGLARILLRWLFRFG

SEQ ID NO: 2515 - protein, 35 aa, Artificial Sequence
  Antimicrobial peptide sequence
GLAWILLRWLFFRGDGGGGGGGLVRILLRWLFRFG

SEQ ID NO: 2516 - protein, 35 aa, Artificial Sequence
  Antimicrobial peptide sequence
GLAWILLRWLFFRGDGGGGGGGLARILLRLLFFRG

SEQ ID NO: 2517 - protein, 35 aa, Artificial Sequence
  Antimicrobial peptide sequence
GLAWILLRWLFFRGDGGGGGGGLARILLRLLFRFG

SEQ ID NO: 2518 - protein, 35 aa, Artificial Sequence
  Antimicrobial peptide sequence
GLAWILLRWLFFRGDGGGGGGGLVRILLRLLFRFG

SEQ ID NO: 2519 - protein, 35 aa, Artificial Sequence
  Antimicrobial peptide sequence
GLAWILLRWLFFRGDGGGGGGSLVRILLRLLLRFG

SEQ ID NO: 2520 - protein, 35 aa, Artificial Sequence
  Antimicrobial peptide sequence
GLAWILLRWLFFRGDGGGGGGGLVRILLRLLLRYG

SEQ ID NO: 2521 - protein, 35 aa, Artificial Sequence
  Antimicrobial peptide sequence
GLAWILLRWLFFRGDGGGGGGGLAWILLRWLFFRG

SEQ ID NO: 2522 - protein, 35 aa, Artificial Sequence
  Antimicrobial peptide sequence
GLAWILLRWLFFRGDGGGGGGGLVRILLRWLFFRG

SEQ ID NO: 2523 - protein, 35 aa, Artificial Sequence
  Antimicrobial peptide sequence
GLAWILLRWLFFRGDGGGGGGGLLRILLRWLFFRG

SEQ ID NO: 2524 - protein, 35 aa, Artificial Sequence
  Antimicrobial peptide sequence
GLAWILLRWLFFRGDGGGGGGGLPWILLRWLFRFG

SEQ ID NO: 2525 - protein, 35 aa, Artificial Sequence
  Antimicrobial peptide sequence
GLAWILLRWLFFRGDGGGGGGGLLRILLRWLFRFG

SEQ ID NO: 2526 - protein, 35 aa, Artificial Sequence
  Antimicrobial peptide sequence
GLAWILLRWLFFRGDGGGGGGGLPWILLRWLFRRG

SEQ ID NO: 2527 - protein, 36 aa, Artificial Sequence
  Antimicrobial peptide sequence
GLAWILLRWLFFRGDGGGGGGGGLPWILLRWLFFRG

SEQ ID NO: 2528 - protein, 36 aa, Artificial Sequence
  Antimicrobial peptide sequence
GLAWILLRWLFFRGDGGGGGGGGLARILLRWLFFRG

SEQ ID NO: 2529 - protein, 36 aa, Artificial Sequence
  Antimicrobial peptide sequence
GLAWILLRWLFFRGDGGGGGGGGLARILLRWLFRFG

SEQ ID NO: 2530 - protein, 36 aa, Artificial Sequence
  Antimicrobial peptide sequence
GLAWILLRWLFFRGDGGGGGGGGLVRILLRWLFRFG

SEQ ID NO: 2531 - protein, 36 aa, Artificial Sequence
  Antimicrobial peptide sequence
GLAWILLRWLFFRGDGGGGGGGGLARILLRLLFFRG

SEQ ID NO: 2532 - protein, 36 aa, Artificial Sequence
  Antimicrobial peptide sequence
GLAWILLRWLFFRGDGGGGGGGGLARILLRLLFRFG

SEQ ID NO: 2533 - protein, 36 aa, Artificial Sequence
  Antimicrobial peptide sequence
GLAWILLRWLFFRGDGGGGGGGGLVRILLRLLFRFG

SEQ ID NO: 2534 - protein, 36 aa, Artificial Sequence
  Antimicrobial peptide sequence
GLAWILLRWLFFRGDGGGGGGGSLVRILLRLLLRFG

SEQ ID NO: 2535 - protein, 36 aa, Artificial Sequence
  Antimicrobial peptide sequence
GLAWILLRWLFFRGDGGGGGGGGLVRILLRLLLRYG

SEQ ID NO: 2536 - protein, 36 aa, Artificial Sequence
  Antimicrobial peptide sequence
GLAWILLRWLFFRGDGGGGGGGGLAWILLRWLFFRG

SEQ ID NO: 2537 - protein, 36 aa, Artificial Sequence
  Antimicrobial peptide sequence
GLAWILLRWLFFRGDGGGGGGGGLVRILLRWLFFRG

SEQ ID NO: 2538 - protein, 36 aa, Artificial Sequence
  Antimicrobial peptide sequence
GLAWILLRWLFFRGDGGGGGGGGLLRILLRWLFFRG

SEQ ID NO: 2539 - protein, 36 aa, Artificial Sequence
  Antimicrobial peptide sequence
GLAWILLRWLFFRGDGGGGGGGGLPWILLRWLFRFG

SEQ ID NO: 2540 - protein, 36 aa, Artificial Sequence
  Antimicrobial peptide sequence
GLAWILLRWLFFRGDGGGGGGGGLLRILLRWLFRFG

SEQ ID NO: 2541 - protein, 36 aa, Artificial Sequence
  Antimicrobial peptide sequence
GLAWILLRWLFFRGDGGGGGGGGLPWILLRWLFRRG

SEQ ID NO: 2542 - protein, 33 aa, Artificial Sequence
  Antimicrobial peptide sequence
GLAWILLRWLFFRGDNNNNGLPWILLRWLFFRG

SEQ ID NO: 2543 - protein, 33 aa, Artificial Sequence
  Antimicrobial peptide sequence
GLAWILLRWLFFRGDNNNNGLARILLRWLFFRG

SEQ ID NO: 2544 - protein, 33 aa, Artificial Sequence
  Antimicrobial peptide sequence
GLAWILLRWLFFRGDNNNNGLARILLRWLFRFG

SEQ ID NO: 2545 - protein, 33 aa, Artificial Sequence
  Antimicrobial peptide sequence
GLAWILLRWLFFRGDNNNNGLVRILLRWLFRFG

SEQ ID NO: 2546 - protein, 33 aa, Artificial Sequence
  Antimicrobial peptide sequence
GLAWILLRWLFFRGDNNNNGLARILLRLLFFRG

SEQ ID NO: 2547 - protein, 33 aa, Artificial Sequence
  Antimicrobial peptide sequence
GLAWILLRWLFFRGDNNNNGLARILLRLLFRFG

SEQ ID NO: 2548 - protein, 33 aa, Artificial Sequence
  Antimicrobial peptide sequence
GLAWILLRWLFFRGDNNNNGLVRILLRLLFRFG

SEQ ID NO: 2549 - protein, 33 aa, Artificial Sequence
  Antimicrobial peptide sequence
GLAWILLRWLFFRGDNNNNSLVRILLRLLLRFG

SEQ ID NO: 2550 - protein, 33 aa, Artificial Sequence
  Antimicrobial peptide sequence
GLAWILLRWLFFRGDNNNNGLVRILLRLLLRYG

SEQ ID NO: 2551 - protein, 33 aa, Artificial Sequence
  Antimicrobial peptide sequence
GLAWILLRWLFFRGDNNNNGLAWILLRWLFFRG

SEQ ID NO: 2552 - protein, 33 aa, Artificial Sequence
  Antimicrobial peptide sequence
GLAWILLRWLFFRGDNNNNGLVRILLRWLFFRG

SEQ ID NO: 2553 - protein, 33 aa, Artificial Sequence
  Antimicrobial peptide sequence
GLAWILLRWLFFRGDNNNNGLLRILLRWLFFRG

SEQ ID NO: 2554 - protein, 33 aa, Artificial Sequence
  Antimicrobial peptide sequence
GLAWILLRWLFFRGDNNNNGLPWILLRWLFRFG

SEQ ID NO: 2555 - protein, 33 aa, Artificial Sequence
  Antimicrobial peptide sequence
GLAWILLRWLFFRGDNNNNGLLRILLRWLFRFG

SEQ ID NO: 2556 - protein, 33 aa, Artificial Sequence
  Antimicrobial peptide sequence
GLAWILLRWLFFRGDNNNNGLPWILLRWLFRRG

SEQ ID NO: 2557 - protein, 34 aa, Artificial Sequence
  Antimicrobial peptide sequence
GLAWILLRWLFFRGDNNNNNGLPWILLRWLFFRG

SEQ ID NO: 2558 - protein, 34 aa, Artificial Sequence
  Antimicrobial peptide sequence
GLAWILLRWLFFRGDNNNNNGLARILLRWLFFRG

SEQ ID NO: 2559 - protein, 34 aa, Artificial Sequence
  Antimicrobial peptide sequence
GLAWILLRWLFFRGDNNNNNGLARILLRWLFRFG

SEQ ID NO: 2560 - protein, 34 aa, Artificial Sequence
  Antimicrobial peptide sequence
GLAWILLRWLFFRGDNNNNNGLVRILLRWLFRFG

SEQ ID NO: 2561 - protein, 34 aa, Artificial Sequence
  Antimicrobial peptide sequence
GLAWILLRWLFFRGDNNNNNGLARILLRLLFFRG

SEQ ID NO: 2562 - protein, 34 aa, Artificial Sequence
  Antimicrobial peptide sequence
GLAWILLRWLFFRGDNNNNNGLARILLRLLFRFG

SEQ ID NO: 2563 - protein, 34 aa, Artificial Sequence
  Antimicrobial peptide sequence
GLAWILLRWLFFRGDNNNNNGLVRILLRLLFRFG

SEQ ID NO: 2564 - protein, 34 aa, Artificial Sequence
  Antimicrobial peptide sequence
GLAWILLRWLFFRGDNNNNNSLVRILLRLLLRFG

SEQ ID NO: 2565 - protein, 34 aa, Artificial Sequence
  Antimicrobial peptide sequence
GLAWILLRWLFFRGDNNNNNGLVRILLRLLLRYG

SEQ ID NO: 2566 - protein, 34 aa, Artificial Sequence
  Antimicrobial peptide sequence
GLAWILLRWLFFRGDNNNNNGLAWILLRWLFFRG

SEQ ID NO: 2567 - protein, 34 aa, Artificial Sequence
  Antimicrobial peptide sequence
GLAWILLRWLFFRGDNNNNNGLVRILLRWLFFRG

SEQ ID NO: 2568 - protein, 34 aa, Artificial Sequence
  Antimicrobial peptide sequence
GLAWILLRWLFFRGDNNNNNGLLRILLRWLFFRG

SEQ ID NO: 2569 - protein, 34 aa, Artificial Sequence
  Antimicrobial peptide sequence
GLAWILLRWLFFRGDNNNNNGLPWILLRWLFRFG

SEQ ID NO: 2570 - protein, 34 aa, Artificial Sequence
  Antimicrobial peptide sequence
GLAWILLRWLFFRGDNNNNNGLLRILLRWLFRFG

SEQ ID NO: 2571 - protein, 34 aa, Artificial Sequence
  Antimicrobial peptide sequence
GLAWILLRWLFFRGDNNNNNGLPWILLRWLFRRG

SEQ ID NO: 2572 - protein, 35 aa, Artificial Sequence
  Antimicrobial peptide sequence
GLAWILLRWLFFRGDNNNNNNGLPWILLRWLFFRG

SEQ ID NO: 2573 - protein, 35 aa, Artificial Sequence
  Antimicrobial peptide sequence
GLAWILLRWLFFRGDNNNNNNGLARILLRWLFFRG

SEQ ID NO: 2574 - protein, 35 aa, Artificial Sequence
  Antimicrobial peptide sequence
GLAWILLRWLFFRGDNNNNNNGLARILLRWLFRFG

SEQ ID NO: 2575 - protein, 35 aa, Artificial Sequence
  Antimicrobial peptide sequence
GLAWILLRWLFFRGDNNNNNNGLVRILLRWLFRFG

SEQ ID NO: 2576 - protein, 35 aa, Artificial Sequence
  Antimicrobial peptide sequence
GLAWILLRWLFFRGDNNNNNNGLARILLRLLFFRG

SEQ ID NO: 2577 - protein, 35 aa, Artificial Sequence
  Antimicrobial peptide sequence
GLAWILLRWLFFRGDNNNNNNGLARILLRLLFRFG

SEQ ID NO: 2578 - protein, 35 aa, Artificial Sequence
  Antimicrobial peptide sequence
GLAWILLRWLFFRGDNNNNNNGLVRILLRLLFRFG

SEQ ID NO: 2579 - protein, 35 aa, Artificial Sequence
  Antimicrobial peptide sequence
GLAWILLRWLFFRGDNNNNNNSLVRILLRLLLRFG

SEQ ID NO: 2580 - protein, 35 aa, Artificial Sequence
  Antimicrobial peptide sequence
GLAWILLRWLFFRGDNNNNNNGLVRILLRLLLRYG

SEQ ID NO: 2581 - protein, 35 aa, Artificial Sequence
  Antimicrobial peptide sequence
GLAWILLRWLFFRGDNNNNNNGLAWILLRWLFFRG

SEQ ID NO: 2582 - protein, 35 aa, Artificial Sequence
  Antimicrobial peptide sequence
GLAWILLRWLFFRGDNNNNNNGLVRILLRWLFFRG

SEQ ID NO: 2583 - protein, 35 aa, Artificial Sequence
  Antimicrobial peptide sequence
GLAWILLRWLFFRGDNNNNNNGLLRILLRWLFFRG

SEQ ID NO: 2584 - protein, 35 aa, Artificial Sequence
  Antimicrobial peptide sequence
GLAWILLRWLFFRGDNNNNNNGLPWILLRWLFRFG

SEQ ID NO: 2585 - protein, 35 aa, Artificial Sequence
  Antimicrobial peptide sequence
GLAWILLRWLFFRGDNNNNNNGLLRILLRWLFRFG

SEQ ID NO: 2586 - protein, 35 aa, Artificial Sequence
  Antimicrobial peptide sequence
GLAWILLRWLFFRGDNNNNNNGLPWILLRWLFRRG

SEQ ID NO: 2587 - protein, 36 aa, Artificial Sequence
  Antimicrobial peptide sequence
GLAWILLRWLFFRGDNNNNNNNGLPWILLRWLFFRG

SEQ ID NO: 2588 - protein, 36 aa, Artificial Sequence
  Antimicrobial peptide sequence
GLAWILLRWLFFRGDNNNNNNNGLARILLRWLFFRG

SEQ ID NO: 2589 - protein, 36 aa, Artificial Sequence
  Antimicrobial peptide sequence
GLAWILLRWLFFRGDNNNNNNNGLARILLRWLFRFG

SEQ ID NO: 2590 - protein, 36 aa, Artificial Sequence
  Antimicrobial peptide sequence
GLAWILLRWLFFRGDNNNNNNNGLVRILLRWLFRFG

SEQ ID NO: 2591 - protein, 36 aa, Artificial Sequence
  Antimicrobial peptide sequence
GLAWILLRWLFFRGDNNNNNNNGLARILLRLLFFRG

SEQ ID NO: 2592 - protein, 36 aa, Artificial Sequence
  Antimicrobial peptide sequence
GLAWILLRWLFFRGDNNNNNNNGLARILLRLLFRFG

SEQ ID NO: 2593 - protein, 36 aa, Artificial Sequence
  Antimicrobial peptide sequence
GLAWILLRWLFFRGDNNNNNNNGLVRILLRLLFRFG

SEQ ID NO: 2594 - protein, 36 aa, Artificial Sequence
  Antimicrobial peptide sequence
GLAWILLRWLFFRGDNNNNNNNSLVRILLRLLLRFG

SEQ ID NO: 2595 - protein, 36 aa, Artificial Sequence
  Antimicrobial peptide sequence
GLAWILLRWLFFRGDNNNNNNNGLVRILLRLLLRYG

SEQ ID NO: 2596 - protein, 36 aa, Artificial Sequence
  Antimicrobial peptide sequence
GLAWILLRWLFFRGDNNNNNNNGLAWILLRWLFFRG

SEQ ID NO: 2597 - protein, 36 aa, Artificial Sequence
  Antimicrobial peptide sequence
GLAWILLRWLFFRGDNNNNNNNGLVRILLRWLFFRG

SEQ ID NO: 2598 - protein, 36 aa, Artificial Sequence
  Antimicrobial peptide sequence
GLAWILLRWLFFRGDNNNNNNNGLLRILLRWLFFRG

SEQ ID NO: 2599 - protein, 36 aa, Artificial Sequence
  Antimicrobial peptide sequence
GLAWILLRWLFFRGDNNNNNNNGLPWILLRWLFRFG

SEQ ID NO: 2600 - protein, 36 aa, Artificial Sequence
  Antimicrobial peptide sequence
GLAWILLRWLFFRGDNNNNNNNGLLRILLRWLFRFG

SEQ ID NO: 2601 - protein, 36 aa, Artificial Sequence
  Antimicrobial peptide sequence
GLAWILLRWLFFRGDNNNNNNNGLPWILLRWLFRRG

SEQ ID NO: 2602 - protein, 35 aa, Artificial Sequence
  Antimicrobial peptide sequence
GLAWILLRWLFFRGDNGNGNGGLPWILLRWLFFRG

SEQ ID NO: 2603 - protein, 35 aa, Artificial Sequence
  Antimicrobial peptide sequence
GLAWILLRWLFFRGDNGNGNGGLARILLRWLFFRG

SEQ ID NO: 2604 - protein, 35 aa, Artificial Sequence
  Antimicrobial peptide sequence
GLAWILLRWLFFRGDNGNGNGGLARILLRWLFRFG

SEQ ID NO: 2605 - protein, 35 aa, Artificial Sequence
  Antimicrobial peptide sequence
GLAWILLRWLFFRGDNGNGNGGLVRILLRWLFRFG

SEQ ID NO: 2606 - protein, 35 aa, Artificial Sequence
  Antimicrobial peptide sequence
GLAWILLRWLFFRGDNGNGNGGLARILLRLLFFRG

SEQ ID NO: 2607 - protein, 35 aa, Artificial Sequence
  Antimicrobial peptide sequence
GLAWILLRWLFFRGDNGNGNGGLARILLRLLFRFG

SEQ ID NO: 2608 - protein, 35 aa, Artificial Sequence
  Antimicrobial peptide sequence
GLAWILLRWLFFRGDNGNGNGGLVRILLRLLFRFG

SEQ ID NO: 2609 - protein, 35 aa, Artificial Sequence
  Antimicrobial peptide sequence
GLAWILLRWLFFRGDNGNGNGSLVRILLRLLLRFG

SEQ ID NO: 2610 - protein, 35 aa, Artificial Sequence
  Antimicrobial peptide sequence
GLAWILLRWLFFRGDNGNGNGGLVRILLRLLLRYG

SEQ ID NO: 2611 - protein, 35 aa, Artificial Sequence
  Antimicrobial peptide sequence
GLAWILLRWLFFRGDNGNGNGGLAWILLRWLFFRG

SEQ ID NO: 2612 - protein, 35 aa, Artificial Sequence
  Antimicrobial peptide sequence
GLAWILLRWLFFRGDNGNGNGGLVRILLRWLFFRG

SEQ ID NO: 2613 - protein, 35 aa, Artificial Sequence
  Antimicrobial peptide sequence
GLAWILLRWLFFRGDNGNGNGGLLRILLRWLFFRG

SEQ ID NO: 2614 - protein, 35 aa, Artificial Sequence
  Antimicrobial peptide sequence
GLAWILLRWLFFRGDNGNGNGGLPWILLRWLFRFG

SEQ ID NO: 2615 - protein, 35 aa, Artificial Sequence
  Antimicrobial peptide sequence
GLAWILLRWLFFRGDNGNGNGGLLRILLRWLFRFG

SEQ ID NO: 2616 - protein, 35 aa, Artificial Sequence
  Antimicrobial peptide sequence
GLAWILLRWLFFRGDNGNGNGGLPWILLRWLFRRG

SEQ ID NO: 2617 - protein, 35 aa, Artificial Sequence
  Antimicrobial peptide sequence
GLAWILLRWLFFRGDGNGNGNGLPWILLRWLFFRG

SEQ ID NO: 2618 - protein, 35 aa, Artificial Sequence
  Antimicrobial peptide sequence
GLAWILLRWLFFRGDGNGNGNGLARILLRWLFFRG

SEQ ID NO: 2619 - protein, 35 aa, Artificial Sequence
  Antimicrobial peptide sequence
GLAWILLRWLFFRGDGNGNGNGLARILLRWLFRFG

SEQ ID NO: 2620 - protein, 35 aa, Artificial Sequence
  Antimicrobial peptide sequence
GLAWILLRWLFFRGDGNGNGNGLVRILLRWLFRFG

SEQ ID NO: 2621 - protein, 35 aa, Artificial Sequence
  Antimicrobial peptide sequence
GLAWILLRWLFFRGDGNGNGNGLARILLRLLFFRG

SEQ ID NO: 2622 - protein, 35 aa, Artificial Sequence
  Antimicrobial peptide sequence
GLAWILLRWLFFRGDGNGNGNGLARILLRLLFRFG

SEQ ID NO: 2623 - protein, 35 aa, Artificial Sequence
  Antimicrobial peptide sequence
GLAWILLRWLFFRGDGNGNGNGLVRILLRLLFRFG

SEQ ID NO: 2624 - protein, 35 aa, Artificial Sequence
  Antimicrobial peptide sequence
GLAWILLRWLFFRGDGNGNGNSLVRILLRLLLRFG

SEQ ID NO: 2625 - protein, 35 aa, Artificial Sequence
  Antimicrobial peptide sequence
GLAWILLRWLFFRGDGNGNGNGLVRILLRLLLRYG

SEQ ID NO: 2626 - protein, 35 aa, Artificial Sequence
  Antimicrobial peptide sequence
GLAWILLRWLFFRGDGNGNGNGLAWILLRWLFFRG

SEQ ID NO: 2627 - protein, 35 aa, Artificial Sequence
  Antimicrobial peptide sequence
GLAWILLRWLFFRGDGNGNGNGLVRILLRWLFFRG

SEQ ID NO: 2628 - protein, 35 aa, Artificial Sequence
  Antimicrobial peptide sequence
GLAWILLRWLFFRGDGNGNGNGLLRILLRWLFFRG

SEQ ID NO: 2629 - protein, 35 aa, Artificial Sequence
  Antimicrobial peptide sequence
GLAWILLRWLFFRGDGNGNGNGLPWILLRWLFRFG

SEQ ID NO: 2630 - protein, 35 aa, Artificial Sequence
  Antimicrobial peptide sequence
GLAWILLRWLFFRGDGNGNGNGLLRILLRWLFRFG

SEQ ID NO: 2631 - protein, 35 aa, Artificial Sequence
  Antimicrobial peptide sequence
GLAWILLRWLFFRGDGNGNGNGLPWILLRWLFRRG

SEQ ID NO: 2632 - protein, 35 aa, Artificial Sequence
  Antimicrobial peptide sequence
GLAWILLRWLFFRGDSGSGSGGLPWILLRWLFFRG

SEQ ID NO: 2633 - protein, 35 aa, Artificial Sequence
  Antimicrobial peptide sequence
GLAWILLRWLFFRGDSGSGSGGLARILLRWLFFRG

SEQ ID NO: 2634 - protein, 35 aa, Artificial Sequence
  Antimicrobial peptide sequence
GLAWILLRWLFFRGDSGSGSGGLARILLRWLFRFG

SEQ ID NO: 2635 - protein, 35 aa, Artificial Sequence
  Antimicrobial peptide sequence
GLAWILLRWLFFRGDSGSGSGGLVRILLRWLFRFG

SEQ ID NO: 2636 - protein, 35 aa, Artificial Sequence
  Antimicrobial peptide sequence
GLAWILLRWLFFRGDSGSGSGGLARILLRLLFFRG

SEQ ID NO: 2637 - protein, 35 aa, Artificial Sequence
  Antimicrobial peptide sequence
GLAWILLRWLFFRGDSGSGSGGLARILLRLLFRFG

SEQ ID NO: 2638 - protein, 35 aa, Artificial Sequence
  Antimicrobial peptide sequence
GLAWILLRWLFFRGDSGSGSGGLVRILLRLLFRFG

SEQ ID NO: 2639 - protein, 35 aa, Artificial Sequence
  Antimicrobial peptide sequence
GLAWILLRWLFFRGDSGSGSGSLVRILLRLLLRFG

SEQ ID NO: 2640 - protein, 35 aa, Artificial Sequence
  Antimicrobial peptide sequence
GLAWILLRWLFFRGDSGSGSGGLVRILLRLLLRYG

SEQ ID NO: 2641 - protein, 35 aa, Artificial Sequence
  Antimicrobial peptide sequence
GLAWILLRWLFFRGDSGSGSGGLAWILLRWLFFRG

SEQ ID NO: 2642 - protein, 35 aa, Artificial Sequence
  Antimicrobial peptide sequence
GLAWILLRWLFFRGDSGSGSGGLVRILLRWLFFRG

SEQ ID NO: 2643 - protein, 35 aa, Artificial Sequence
  Antimicrobial peptide sequence
GLAWILLRWLFFRGDSGSGSGGLLRILLRWLFFRG

SEQ ID NO: 2644 - protein, 35 aa, Artificial Sequence
  Antimicrobial peptide sequence
GLAWILLRWLFFRGDSGSGSGGLPWILLRWLFRFG

SEQ ID NO: 2645 - protein, 35 aa, Artificial Sequence
  Antimicrobial peptide sequence
GLAWILLRWLFFRGDSGSGSGGLLRILLRWLFRFG

SEQ ID NO: 2646 - protein, 35 aa, Artificial Sequence
  Antimicrobial peptide sequence
GLAWILLRWLFFRGDSGSGSGGLPWILLRWLFRRG

SEQ ID NO: 2647 - protein, 35 aa, Artificial Sequence
  Antimicrobial peptide sequence
GLAWILLRWLFFRGDGSGSGSGLPWILLRWLFFRG

SEQ ID NO: 2648 - protein, 35 aa, Artificial Sequence
  Antimicrobial peptide sequence
GLAWILLRWLFFRGDGSGSGSGLARILLRWLFFRG

SEQ ID NO: 2649 - protein, 35 aa, Artificial Sequence
  Antimicrobial peptide sequence
GLAWILLRWLFFRGDGSGSGSGLARILLRWLFRFG

SEQ ID NO: 2650 - protein, 35 aa, Artificial Sequence
  Antimicrobial peptide sequence
GLAWILLRWLFFRGDGSGSGSGLVRILLRWLFRFG

SEQ ID NO: 2651 - protein, 35 aa, Artificial Sequence
  Antimicrobial peptide sequence
GLAWILLRWLFFRGDGSGSGSGLARILLRLLFFRG

SEQ ID NO: 2652 - protein, 35 aa, Artificial Sequence
  Antimicrobial peptide sequence
GLAWILLRWLFFRGDGSGSGSGLARILLRLLFRFG

SEQ ID NO: 2653 - protein, 35 aa, Artificial Sequence
  Antimicrobial peptide sequence
GLAWILLRWLFFRGDGSGSGSGLVRILLRLLFRFG

SEQ ID NO: 2654 - protein, 35 aa, Artificial Sequence
  Antimicrobial peptide sequence
GLAWILLRWLFFRGDGSGSGSSLVRILLRLLLRFG

SEQ ID NO: 2655 - protein, 35 aa, Artificial Sequence
  Antimicrobial peptide sequence
GLAWILLRWLFFRGDGSGSGSGLVRILLRLLLRYG

SEQ ID NO: 2656 - protein, 35 aa, Artificial Sequence
  Antimicrobial peptide sequence
GLAWILLRWLFFRGDGSGSGSGLAWILLRWLFFRG

SEQ ID NO: 2657 - protein, 35 aa, Artificial Sequence
  Antimicrobial peptide sequence
GLAWILLRWLFFRGDGSGSGSGLVRILLRWLFFRG

SEQ ID NO: 2658 - protein, 35 aa, Artificial Sequence
  Antimicrobial peptide sequence
GLAWILLRWLFFRGDGSGSGSGLLRILLRWLFFRG

SEQ ID NO: 2659 - protein, 35 aa, Artificial Sequence
  Antimicrobial peptide sequence
GLAWILLRWLFFRGDGSGSGSGLPWILLRWLFRFG

SEQ ID NO: 2660 - protein, 35 aa, Artificial Sequence
  Antimicrobial peptide sequence
GLAWILLRWLFFRGDGSGSGSGLLRILLRWLFRFG

SEQ ID NO: 2661 - protein, 35 aa, Artificial Sequence
  Antimicrobial peptide sequence
GLAWILLRWLFFRGDGSGSGSGLPWILLRWLFRRG

SEQ ID NO: 2662 - protein, 35 aa, Artificial Sequence
  Antimicrobial peptide sequence
GLAWILLRWLFFRGDSNSNSNGLPWILLRWLFFRG

SEQ ID NO: 2663 - protein, 35 aa, Artificial Sequence
  Antimicrobial peptide sequence
GLAWILLRWLFFRGDSNSNSNGLARILLRWLFFRG

SEQ ID NO: 2664 - protein, 35 aa, Artificial Sequence
  Antimicrobial peptide sequence
GLAWILLRWLFFRGDSNSNSNGLARILLRWLFRFG

SEQ ID NO: 2665 - protein, 35 aa, Artificial Sequence
  Antimicrobial peptide sequence
GLAWILLRWLFFRGDSNSNSNGLVRILLRWLFRFG

SEQ ID NO: 2666 - protein, 35 aa, Artificial Sequence
  Antimicrobial peptide sequence
GLAWILLRWLFFRGDSNSNSNGLARILLRLLFFRG

SEQ ID NO: 2667 - protein, 35 aa, Artificial Sequence
  Antimicrobial peptide sequence
GLAWILLRWLFFRGDSNSNSNGLARILLRLLFRFG

SEQ ID NO: 2668 - protein, 35 aa, Artificial Sequence
  Antimicrobial peptide sequence
GLAWILLRWLFFRGDSNSNSNGLVRILLRLLFRFG

SEQ ID NO: 2669 - protein, 35 aa, Artificial Sequence
  Antimicrobial peptide sequence
GLAWILLRWLFFRGDSNSNSNSLVRILLRLLLRFG

SEQ ID NO: 2670 - protein, 35 aa, Artificial Sequence
  Antimicrobial peptide sequence
GLAWILLRWLFFRGDSNSNSNGLVRILLRLLLRYG

SEQ ID NO: 2671 - protein, 35 aa, Artificial Sequence
  Antimicrobial peptide sequence
GLAWILLRWLFFRGDSNSNSNGLAWILLRWLFFRG

SEQ ID NO: 2672 - protein, 35 aa, Artificial Sequence
  Antimicrobial peptide sequence
GLAWILLRWLFFRGDSNSNSNGLVRILLRWLFFRG

SEQ ID NO: 2673 - protein, 35 aa, Artificial Sequence
  Antimicrobial peptide sequence
GLAWILLRWLFFRGDSNSNSNGLLRILLRWLFFRG

SEQ ID NO: 2674 - protein, 35 aa, Artificial Sequence
  Antimicrobial peptide sequence
GLAWILLRWLFFRGDSNSNSNGLPWILLRWLFRFG

SEQ ID NO: 2675 - protein, 35 aa, Artificial Sequence
  Antimicrobial peptide sequence
GLAWILLRWLFFRGDSNSNSNGLLRILLRWLFRFG

SEQ ID NO: 2676 - protein, 35 aa, Artificial Sequence
  Antimicrobial peptide sequence
GLAWILLRWLFFRGDSNSNSNGLPWILLRWLFRRG

SEQ ID NO: 2677 - protein, 35 aa, Artificial Sequence
  Antimicrobial peptide sequence
GLAWILLRWLFFRGDNSNSNSGLPWILLRWLFFRG

SEQ ID NO: 2678 - protein, 35 aa, Artificial Sequence
  Antimicrobial peptide sequence
GLAWILLRWLFFRGDNSNSNSGLARILLRWLFFRG

SEQ ID NO: 2679 - protein, 35 aa, Artificial Sequence
  Antimicrobial peptide sequence
GLAWILLRWLFFRGDNSNSNSGLARILLRWLFRFG

SEQ ID NO: 2680 - protein, 35 aa, Artificial Sequence
  Antimicrobial peptide sequence
GLAWILLRWLFFRGDNSNSNSGLVRILLRWLFRFG

SEQ ID NO: 2681 - protein, 35 aa, Artificial Sequence
  Antimicrobial peptide sequence
GLAWILLRWLFFRGDNSNSNSGLARILLRLLFFRG

SEQ ID NO: 2682 - protein, 35 aa, Artificial Sequence
  Antimicrobial peptide sequence
GLAWILLRWLFFRGDNSNSNSGLARILLRLLFRFG

SEQ ID NO: 2683 - protein, 35 aa, Artificial Sequence
  Antimicrobial peptide sequence
GLAWILLRWLFFRGDNSNSNSGLVRILLRLLFRFG

SEQ ID NO: 2684 - protein, 35 aa, Artificial Sequence
  Antimicrobial peptide sequence
GLAWILLRWLFFRGDNSNSNSSLVRILLRLLLRFG

SEQ ID NO: 2685 - protein, 35 aa, Artificial Sequence
  Antimicrobial peptide sequence
GLAWILLRWLFFRGDNSNSNSGLVRILLRLLLRYG

SEQ ID NO: 2686 - protein, 35 aa, Artificial Sequence
  Antimicrobial peptide sequence
GLAWILLRWLFFRGDNSNSNSGLAWILLRWLFFRG

SEQ ID NO: 2687 - protein, 35 aa, Artificial Sequence
  Antimicrobial peptide sequence
GLAWILLRWLFFRGDNSNSNSGLVRILLRWLFFRG

SEQ ID NO: 2688 - protein, 35 aa, Artificial Sequence
  Antimicrobial peptide sequence
GLAWILLRWLFFRGDNSNSNSGLLRILLRWLFFRG

SEQ ID NO: 2689 - protein, 35 aa, Artificial Sequence
  Antimicrobial peptide sequence
GLAWILLRWLFFRGDNSNSNSGLPWILLRWLFRFG

SEQ ID NO: 2690 - protein, 35 aa, Artificial Sequence
  Antimicrobial peptide sequence
GLAWILLRWLFFRGDNSNSNSGLLRILLRWLFRFG

SEQ ID NO: 2691 - protein, 35 aa, Artificial Sequence
  Antimicrobial peptide sequence
GLAWILLRWLFFRGDNSNSNSGLPWILLRWLFRRG

SEQ ID NO: 2692 - protein, 35 aa, Artificial Sequence
  Antimicrobial peptide sequence
GLAWILLRWLFFRGDHGHGHGGLPWILLRWLFFRG

SEQ ID NO: 2693 - protein, 35 aa, Artificial Sequence
  Antimicrobial peptide sequence
GLAWILLRWLFFRGDHGHGHGGLARILLRWLFFRG

SEQ ID NO: 2694 - protein, 35 aa, Artificial Sequence
  Antimicrobial peptide sequence
GLAWILLRWLFFRGDHGHGHGGLARILLRWLFRFG

SEQ ID NO: 2695 - protein, 35 aa, Artificial Sequence
  Antimicrobial peptide sequence
GLAWILLRWLFFRGDHGHGHGGLVRILLRWLFRFG

SEQ ID NO: 2696 - protein, 35 aa, Artificial Sequence
  Antimicrobial peptide sequence
GLAWILLRWLFFRGDHGHGHGGLARILLRLLFFRG

SEQ ID NO: 2697 - protein, 35 aa, Artificial Sequence
  Antimicrobial peptide sequence
GLAWILLRWLFFRGDHGHGHGGLARILLRLLFRFG

SEQ ID NO: 2698 - protein, 35 aa, Artificial Sequence
  Antimicrobial peptide sequence
GLAWILLRWLFFRGDHGHGHGGLVRILLRLLFRFG

SEQ ID NO: 2699 - protein, 35 aa, Artificial Sequence
  Antimicrobial peptide sequence
GLAWILLRWLFFRGDHGHGHGSLVRILLRLLLRFG

SEQ ID NO: 2700 - protein, 35 aa, Artificial Sequence
  Antimicrobial peptide sequence
GLAWILLRWLFFRGDHGHGHGGLVRILLRLLLRYG

SEQ ID NO: 2701 - protein, 35 aa, Artificial Sequence
  Antimicrobial peptide sequence
GLAWILLRWLFFRGDHGHGHGGLAWILLRWLFFRG

SEQ ID NO: 2702 - protein, 35 aa, Artificial Sequence
  Antimicrobial peptide sequence
GLAWILLRWLFFRGDHGHGHGGLVRILLRWLFFRG

SEQ ID NO: 2703 - protein, 35 aa, Artificial Sequence
  Antimicrobial peptide sequence
GLAWILLRWLFFRGDHGHGHGGLLRILLRWLFFRG

SEQ ID NO: 2704 - protein, 35 aa, Artificial Sequence
  Antimicrobial peptide sequence
GLAWILLRWLFFRGDHGHGHGGLPWILLRWLFRFG

SEQ ID NO: 2705 - protein, 35 aa, Artificial Sequence
  Antimicrobial peptide sequence
GLAWILLRWLFFRGDHGHGHGGLLRILLRWLFRFG

SEQ ID NO: 2706 - protein, 35 aa, Artificial Sequence
  Antimicrobial peptide sequence
GLAWILLRWLFFRGDHGHGHGGLPWILLRWLFRRG

SEQ ID NO: 2707 - protein, 35 aa, Artificial Sequence
  Antimicrobial peptide sequence
GLAWILLRWLFFRGDGHGHGHGLPWILLRWLFFRG

SEQ ID NO: 2708 - protein, 35 aa, Artificial Sequence
  Antimicrobial peptide sequence
GLAWILLRWLFFRGDGHGHGHGLARILLRWLFFRG

SEQ ID NO: 2709 - protein, 35 aa, Artificial Sequence
  Antimicrobial peptide sequence
GLAWILLRWLFFRGDGHGHGHGLARILLRWLFRFG

SEQ ID NO: 2710 - protein, 35 aa, Artificial Sequence
  Antimicrobial peptide sequence
GLAWILLRWLFFRGDGHGHGHGLVRILLRWLFRFG

SEQ ID NO: 2711 - protein, 35 aa, Artificial Sequence
  Antimicrobial peptide sequence
GLAWILLRWLFFRGDGHGHGHGLARILLRLLFFRG

SEQ ID NO: 2712 - protein, 35 aa, Artificial Sequence
  Antimicrobial peptide sequence
GLAWILLRWLFFRGDGHGHGHGLARILLRLLFRFG

SEQ ID NO: 2713 - protein, 35 aa, Artificial Sequence
  Antimicrobial peptide sequence
GLAWILLRWLFFRGDGHGHGHGLVRILLRLLFRFG

SEQ ID NO: 2714 - protein, 35 aa, Artificial Sequence
  Antimicrobial peptide sequence
GLAWILLRWLFFRGDGHGHGHSLVRILLRLLLRFG

SEQ ID NO: 2715 - protein, 35 aa, Artificial Sequence
  Antimicrobial peptide sequence
GLAWILLRWLFFRGDGHGHGHGLVRILLRLLLRYG

SEQ ID NO: 2716 - protein, 35 aa, Artificial Sequence
  Antimicrobial peptide sequence
GLAWILLRWLFFRGDGHGHGHGLAWILLRWLFFRG

SEQ ID NO: 2717 - protein, 35 aa, Artificial Sequence
  Antimicrobial peptide sequence
GLAWILLRWLFFRGDGHGHGHGLVRILLRWLFFRG

SEQ ID NO: 2718 - protein, 35 aa, Artificial Sequence
  Antimicrobial peptide sequence
GLAWILLRWLFFRGDGHGHGHGLLRILLRWLFFRG

SEQ ID NO: 2719 - protein, 35 aa, Artificial Sequence
  Antimicrobial peptide sequence
GLAWILLRWLFFRGDGHGHGHGLPWILLRWLFRFG

SEQ ID NO: 2720 - protein, 35 aa, Artificial Sequence
  Antimicrobial peptide sequence
GLAWILLRWLFFRGDGHGHGHGLLRILLRWLFRFG

SEQ ID NO: 2721 - protein, 35 aa, Artificial Sequence
  Antimicrobial peptide sequence
GLAWILLRWLFFRGDGHGHGHGLPWILLRWLFRRG

SEQ ID NO: 2722 - protein, 35 aa, Artificial Sequence
  Antimicrobial peptide sequence
GLAWILLRWLFFRGDHNHNHNGLPWILLRWLFFRG

SEQ ID NO: 2723 - protein, 35 aa, Artificial Sequence
  Antimicrobial peptide sequence
GLAWILLRWLFFRGDHNHNHNGLARILLRWLFFRG

SEQ ID NO: 2724 - protein, 35 aa, Artificial Sequence
  Antimicrobial peptide sequence
GLAWILLRWLFFRGDHNHNHNGLARILLRWLFRFG

SEQ ID NO: 2725 - protein, 35 aa, Artificial Sequence
  Antimicrobial peptide sequence
GLAWILLRWLFFRGDHNHNHNGLVRILLRWLFRFG

SEQ ID NO: 2726 - protein, 35 aa, Artificial Sequence
  Antimicrobial peptide sequence
GLAWILLRWLFFRGDHNHNHNGLARILLRLLFFRG

SEQ ID NO: 2727 - protein, 35 aa, Artificial Sequence
  Antimicrobial peptide sequence
GLAWILLRWLFFRGDHNHNHNGLARILLRLLFRFG

SEQ ID NO: 2728 - protein, 35 aa, Artificial Sequence
  Antimicrobial peptide sequence
GLAWILLRWLFFRGDHNHNHNGLVRILLRLLFRFG

SEQ ID NO: 2729 - protein, 35 aa, Artificial Sequence
  Antimicrobial peptide sequence
GLAWILLRWLFFRGDHNHNHNSLVRILLRLLLRFG

SEQ ID NO: 2730 - protein, 35 aa, Artificial Sequence
  Antimicrobial peptide sequence
GLAWILLRWLFFRGDHNHNHNGLVRILLRLLLRYG

SEQ ID NO: 2731 - protein, 35 aa, Artificial Sequence
  Antimicrobial peptide sequence
GLAWILLRWLFFRGDHNHNHNGLAWILLRWLFFRG

SEQ ID NO: 2732 - protein, 35 aa, Artificial Sequence
  Antimicrobial peptide sequence
GLAWILLRWLFFRGDHNHNHNGLVRILLRWLFFRG

SEQ ID NO: 2733 - protein, 35 aa, Artificial Sequence
  Antimicrobial peptide sequence
GLAWILLRWLFFRGDHNHNHNGLLRILLRWLFFRG

SEQ ID NO: 2734 - protein, 35 aa, Artificial Sequence
  Antimicrobial peptide sequence
GLAWILLRWLFFRGDHNHNHNGLPWILLRWLFRFG

SEQ ID NO: 2735 - protein, 35 aa, Artificial Sequence
  Antimicrobial peptide sequence
GLAWILLRWLFFRGDHNHNHNGLLRILLRWLFRFG

SEQ ID NO: 2736 - protein, 35 aa, Artificial Sequence
  Antimicrobial peptide sequence
GLAWILLRWLFFRGDHNHNHNGLPWILLRWLFRRG

SEQ ID NO: 2737 - protein, 35 aa, Artificial Sequence
  Antimicrobial peptide sequence
GLAWILLRWLFFRGDNHNHNHGLPWILLRWLFFRG

SEQ ID NO: 2738 - protein, 35 aa, Artificial Sequence
  Antimicrobial peptide sequence
GLAWILLRWLFFRGDNHNHNHGLARILLRWLFFRG

SEQ ID NO: 2739 - protein, 35 aa, Artificial Sequence
  Antimicrobial peptide sequence
GLAWILLRWLFFRGDNHNHNHGLARILLRWLFRFG

SEQ ID NO: 2740 - protein, 35 aa, Artificial Sequence
  Antimicrobial peptide sequence
GLAWILLRWLFFRGDNHNHNHGLVRILLRWLFRFG

SEQ ID NO: 2741 - protein, 35 aa, Artificial Sequence
  Antimicrobial peptide sequence
GLAWILLRWLFFRGDNHNHNHGLARILLRLLFFRG

SEQ ID NO: 2742 - protein, 35 aa, Artificial Sequence
  Antimicrobial peptide sequence
GLAWILLRWLFFRGDNHNHNHGLARILLRLLFRFG

SEQ ID NO: 2743 - protein, 35 aa, Artificial Sequence
  Antimicrobial peptide sequence
GLAWILLRWLFFRGDNHNHNHGLVRILLRLLFRFG

SEQ ID NO: 2744 - protein, 35 aa, Artificial Sequence
  Antimicrobial peptide sequence
GLAWILLRWLFFRGDNHNHNHSLVRILLRLLLRFG

SEQ ID NO: 2745 - protein, 35 aa, Artificial Sequence
  Antimicrobial peptide sequence
GLAWILLRWLFFRGDNHNHNHGLVRILLRLLLRYG

SEQ ID NO: 2746 - protein, 35 aa, Artificial Sequence
  Antimicrobial peptide sequence
GLAWILLRWLFFRGDNHNHNHGLAWILLRWLFFRG

SEQ ID NO: 2747 - protein, 35 aa, Artificial Sequence
  Antimicrobial peptide sequence
GLAWILLRWLFFRGDNHNHNHGLVRILLRWLFFRG

SEQ ID NO: 2748 - protein, 35 aa, Artificial Sequence
  Antimicrobial peptide sequence
GLAWILLRWLFFRGDNHNHNHGLLRILLRWLFFRG

SEQ ID NO: 2749 - protein, 35 aa, Artificial Sequence
  Antimicrobial peptide sequence
GLAWILLRWLFFRGDNHNHNHGLPWILLRWLFRFG

SEQ ID NO: 2750 - protein, 35 aa, Artificial Sequence
  Antimicrobial peptide sequence
GLAWILLRWLFFRGDNHNHNHGLLRILLRWLFRFG

SEQ ID NO: 2751 - protein, 35 aa, Artificial Sequence
  Antimicrobial peptide sequence
GLAWILLRWLFFRGDNHNHNHGLPWILLRWLFRRG

SEQ ID NO: 2752 - protein, 33 aa, Artificial Sequence
  Antimicrobial peptide sequence
GLVRILLRWLFFRGDGGGGGLPWILLRWLFFRG

SEQ ID NO: 2753 - protein, 33 aa, Artificial Sequence
  Antimicrobial peptide sequence
GLVRILLRWLFFRGDGGGGGLARILLRWLFFRG

SEQ ID NO: 2754 - protein, 33 aa, Artificial Sequence
  Antimicrobial peptide sequence
GLVRILLRWLFFRGDGGGGGLARILLRWLFRFG

SEQ ID NO: 2755 - protein, 33 aa, Artificial Sequence
  Antimicrobial peptide sequence
GLVRILLRWLFFRGDGGGGGLVRILLRWLFRFG

SEQ ID NO: 2756 - protein, 33 aa, Artificial Sequence
  Antimicrobial peptide sequence
GLVRILLRWLFFRGDGGGGGLARILLRLLFFRG

SEQ ID NO: 2757 - protein, 33 aa, Artificial Sequence
  Antimicrobial peptide sequence
GLVRILLRWLFFRGDGGGGGLARILLRLLFRFG

SEQ ID NO: 2758 - protein, 33 aa, Artificial Sequence
  Antimicrobial peptide sequence
GLVRILLRWLFFRGDGGGGGLVRILLRLLFRFG

SEQ ID NO: 2759 - protein, 33 aa, Artificial Sequence
  Antimicrobial peptide sequence
GLVRILLRWLFFRGDGGGGSLVRILLRLLLRFG

SEQ ID NO: 2760 - protein, 33 aa, Artificial Sequence
  Antimicrobial peptide sequence
GLVRILLRWLFFRGDGGGGGLVRILLRLLLRYG

SEQ ID NO: 2761 - protein, 33 aa, Artificial Sequence
  Antimicrobial peptide sequence
GLVRILLRWLFFRGDGGGGGLAWILLRWLFFRG

SEQ ID NO: 2762 - protein, 33 aa, Artificial Sequence
  Antimicrobial peptide sequence
GLVRILLRWLFFRGDGGGGGLVRILLRWLFFRG

SEQ ID NO: 2763 - protein, 33 aa, Artificial Sequence
  Antimicrobial peptide sequence
GLVRILLRWLFFRGDGGGGGLLRILLRWLFFRG

SEQ ID NO: 2764 - protein, 33 aa, Artificial Sequence
  Antimicrobial peptide sequence
GLVRILLRWLFFRGDGGGGGLPWILLRWLFRFG

SEQ ID NO: 2765 - protein, 33 aa, Artificial Sequence
  Antimicrobial peptide sequence
GLVRILLRWLFFRGDGGGGGLLRILLRWLFRFG

SEQ ID NO: 2766 - protein, 33 aa, Artificial Sequence
  Antimicrobial peptide sequence
GLVRILLRWLFFRGDGGGGGLPWILLRWLFRRG

SEQ ID NO: 2767 - protein, 34 aa, Artificial Sequence
  Antimicrobial peptide sequence
GLVRILLRWLFFRGDGGGGGGLPWILLRWLFFRG

SEQ ID NO: 2768 - protein, 34 aa, Artificial Sequence
  Antimicrobial peptide sequence
GLVRILLRWLFFRGDGGGGGGLARILLRWLFFRG

SEQ ID NO: 2769 - protein, 34 aa, Artificial Sequence
  Antimicrobial peptide sequence
GLVRILLRWLFFRGDGGGGGGLARILLRWLFRFG

SEQ ID NO: 2770 - protein, 34 aa, Artificial Sequence
  Antimicrobial peptide sequence
GLVRILLRWLFFRGDGGGGGGLVRILLRWLFRFG

SEQ ID NO: 2771 - protein, 34 aa, Artificial Sequence
  Antimicrobial peptide sequence
GLVRILLRWLFFRGDGGGGGGLARILLRLLFFRG

SEQ ID NO: 2772 - protein, 34 aa, Artificial Sequence
  Antimicrobial peptide sequence
GLVRILLRWLFFRGDGGGGGGLARILLRLLFRFG

SEQ ID NO: 2773 - protein, 34 aa, Artificial Sequence
  Antimicrobial peptide sequence
GLVRILLRWLFFRGDGGGGGGLVRILLRLLFRFG

SEQ ID NO: 2774 - protein, 34 aa, Artificial Sequence
  Antimicrobial peptide sequence
GLVRILLRWLFFRGDGGGGGSLVRILLRLLLRFG

SEQ ID NO: 2775 - protein, 34 aa, Artificial Sequence
  Antimicrobial peptide sequence
GLVRILLRWLFFRGDGGGGGGLVRILLRLLLRYG

SEQ ID NO: 2776 - protein, 34 aa, Artificial Sequence
  Antimicrobial peptide sequence
GLVRILLRWLFFRGDGGGGGGLAWILLRWLFFRG

SEQ ID NO: 2777 - protein, 34 aa, Artificial Sequence
  Antimicrobial peptide sequence
GLVRILLRWLFFRGDGGGGGGLVRILLRWLFFRG

SEQ ID NO: 2778 - protein, 34 aa, Artificial Sequence
  Antimicrobial peptide sequence
GLVRILLRWLFFRGDGGGGGGLLRILLRWLFFRG

SEQ ID NO: 2779 - protein, 34 aa, Artificial Sequence
  Antimicrobial peptide sequence
GLVRILLRWLFFRGDGGGGGGLPWILLRWLFRFG

SEQ ID NO: 2780 - protein, 34 aa, Artificial Sequence
  Antimicrobial peptide sequence
GLVRILLRWLFFRGDGGGGGGLLRILLRWLFRFG

SEQ ID NO: 2781 - protein, 34 aa, Artificial Sequence
  Antimicrobial peptide sequence
GLVRILLRWLFFRGDGGGGGGLPWILLRWLFRRG

SEQ ID NO: 2782 - protein, 35 aa, Artificial Sequence
  Antimicrobial peptide sequence
GLVRILLRWLFFRGDGGGGGGGLPWILLRWLFFRG

SEQ ID NO: 2783 - protein, 35 aa, Artificial Sequence
  Antimicrobial peptide sequence
GLVRILLRWLFFRGDGGGGGGGLARILLRWLFFRG

SEQ ID NO: 2784 - protein, 35 aa, Artificial Sequence
  Antimicrobial peptide sequence
GLVRILLRWLFFRGDGGGGGGGLARILLRWLFRFG

SEQ ID NO: 2785 - protein, 35 aa, Artificial Sequence
  Antimicrobial peptide sequence
GLVRILLRWLFFRGDGGGGGGGLVRILLRWLFRFG

SEQ ID NO: 2786 - protein, 35 aa, Artificial Sequence
  Antimicrobial peptide sequence
GLVRILLRWLFFRGDGGGGGGGLARILLRLLFFRG

SEQ ID NO: 2787 - protein, 35 aa, Artificial Sequence
  Antimicrobial peptide sequence
GLVRILLRWLFFRGDGGGGGGGLARILLRLLFRFG

SEQ ID NO: 2788 - protein, 35 aa, Artificial Sequence
  Antimicrobial peptide sequence
GLVRILLRWLFFRGDGGGGGGGLVRILLRLLFRFG

SEQ ID NO: 2789 - protein, 35 aa, Artificial Sequence
  Antimicrobial peptide sequence
GLVRILLRWLFFRGDGGGGGGSLVRILLRLLLRFG

SEQ ID NO: 2790 - protein, 35 aa, Artificial Sequence
  Antimicrobial peptide sequence
GLVRILLRWLFFRGDGGGGGGGLVRILLRLLLRYG

SEQ ID NO: 2791 - protein, 35 aa, Artificial Sequence
  Antimicrobial peptide sequence
GLVRILLRWLFFRGDGGGGGGGLAWILLRWLFFRG

SEQ ID NO: 2792 - protein, 35 aa, Artificial Sequence
  Antimicrobial peptide sequence
GLVRILLRWLFFRGDGGGGGGGLVRILLRWLFFRG

SEQ ID NO: 2793 - protein, 35 aa, Artificial Sequence
  Antimicrobial peptide sequence
GLVRILLRWLFFRGDGGGGGGGLLRILLRWLFFRG

SEQ ID NO: 2794 - protein, 35 aa, Artificial Sequence
  Antimicrobial peptide sequence
GLVRILLRWLFFRGDGGGGGGGLPWILLRWLFRFG

SEQ ID NO: 2795 - protein, 35 aa, Artificial Sequence
  Antimicrobial peptide sequence
GLVRILLRWLFFRGDGGGGGGGLLRILLRWLFRFG

SEQ ID NO: 2796 - protein, 35 aa, Artificial Sequence
  Antimicrobial peptide sequence
GLVRILLRWLFFRGDGGGGGGGLPWILLRWLFRRG

SEQ ID NO: 2797 - protein, 36 aa, Artificial Sequence
  Antimicrobial peptide sequence
GLVRILLRWLFFRGDGGGGGGGGLPWILLRWLFFRG

SEQ ID NO: 2798 - protein, 36 aa, Artificial Sequence
  Antimicrobial peptide sequence
GLVRILLRWLFFRGDGGGGGGGGLARILLRWLFFRG

SEQ ID NO: 2799 - protein, 36 aa, Artificial Sequence
  Antimicrobial peptide sequence
GLVRILLRWLFFRGDGGGGGGGGLARILLRWLFRFG

SEQ ID NO: 2800 - protein, 36 aa, Artificial Sequence
  Antimicrobial peptide sequence
GLVRILLRWLFFRGDGGGGGGGGLVRILLRWLFRFG

SEQ ID NO: 2801 - protein, 36 aa, Artificial Sequence
  Antimicrobial peptide sequence
GLVRILLRWLFFRGDGGGGGGGGLARILLRLLFFRG

SEQ ID NO: 2802 - protein, 36 aa, Artificial Sequence
  Antimicrobial peptide sequence
GLVRILLRWLFFRGDGGGGGGGGLARILLRLLFRFG

SEQ ID NO: 2803 - protein, 36 aa, Artificial Sequence
  Antimicrobial peptide sequence
GLVRILLRWLFFRGDGGGGGGGGLVRILLRLLFRFG

SEQ ID NO: 2804 - protein, 36 aa, Artificial Sequence
  Antimicrobial peptide sequence
GLVRILLRWLFFRGDGGGGGGGSLVRILLRLLLRFG

SEQ ID NO: 2805 - protein, 36 aa, Artificial Sequence
  Antimicrobial peptide sequence
GLVRILLRWLFFRGDGGGGGGGGLVRILLRLLLRYG

SEQ ID NO: 2806 - protein, 36 aa, Artificial Sequence
  Antimicrobial peptide sequence
GLVRILLRWLFFRGDGGGGGGGGLAWILLRWLFFRG

SEQ ID NO: 2807 - protein, 36 aa, Artificial Sequence
  Antimicrobial peptide sequence
GLVRILLRWLFFRGDGGGGGGGGLVRILLRWLFFRG

SEQ ID NO: 2808 - protein, 36 aa, Artificial Sequence
  Antimicrobial peptide sequence
GLVRILLRWLFFRGDGGGGGGGGLLRILLRWLFFRG

SEQ ID NO: 2809 - protein, 36 aa, Artificial Sequence
  Antimicrobial peptide sequence
GLVRILLRWLFFRGDGGGGGGGGLPWILLRWLFRFG

SEQ ID NO: 2810 - protein, 36 aa, Artificial Sequence
  Antimicrobial peptide sequence
GLVRILLRWLFFRGDGGGGGGGGLLRILLRWLFRFG

SEQ ID NO: 2811 - protein, 36 aa, Artificial Sequence
  Antimicrobial peptide sequence
GLVRILLRWLFFRGDGGGGGGGGLPWILLRWLFRRG

SEQ ID NO: 2812 - protein, 33 aa, Artificial Sequence
  Antimicrobial peptide sequence
GLVRILLRWLFFRGDNNNNGLPWILLRWLFFRG

SEQ ID NO: 2813 - protein, 33 aa, Artificial Sequence
  Antimicrobial peptide sequence
GLVRILLRWLFFRGDNNNNGLARILLRWLFFRG

SEQ ID NO: 2814 - protein, 33 aa, Artificial Sequence
  Antimicrobial peptide sequence
GLVRILLRWLFFRGDNNNNGLARILLRWLFRFG

SEQ ID NO: 2815 - protein, 33 aa, Artificial Sequence
  Antimicrobial peptide sequence
GLVRILLRWLFFRGDNNNNGLVRILLRWLFRFG

SEQ ID NO: 2816 - protein, 33 aa, Artificial Sequence
  Antimicrobial peptide sequence
GLVRILLRWLFFRGDNNNNGLARILLRLLFFRG

SEQ ID NO: 2817 - protein, 33 aa, Artificial Sequence
  Antimicrobial peptide sequence
GLVRILLRWLFFRGDNNNNGLARILLRLLFRFG

SEQ ID NO: 2818 - protein, 33 aa, Artificial Sequence
  Antimicrobial peptide sequence
GLVRILLRWLFFRGDNNNNGLVRILLRLLFRFG

SEQ ID NO: 2819 - protein, 33 aa, Artificial Sequence
  Antimicrobial peptide sequence
GLVRILLRWLFFRGDNNNNSLVRILLRLLLRFG

SEQ ID NO: 2820 - protein, 33 aa, Artificial Sequence
  Antimicrobial peptide sequence
GLVRILLRWLFFRGDNNNNGLVRILLRLLLRYG

SEQ ID NO: 2821 - protein, 33 aa, Artificial Sequence
  Antimicrobial peptide sequence
GLVRILLRWLFFRGDNNNNGLAWILLRWLFFRG

SEQ ID NO: 2822 - protein, 33 aa, Artificial Sequence
  Antimicrobial peptide sequence
GLVRILLRWLFFRGDNNNNGLVRILLRWLFFRG

SEQ ID NO: 2823 - protein, 33 aa, Artificial Sequence
  Antimicrobial peptide sequence
GLVRILLRWLFFRGDNNNNGLLRILLRWLFFRG

SEQ ID NO: 2824 - protein, 33 aa, Artificial Sequence
  Antimicrobial peptide sequence
GLVRILLRWLFFRGDNNNNGLPWILLRWLFRFG

SEQ ID NO: 2825 - protein, 33 aa, Artificial Sequence
  Antimicrobial peptide sequence
GLVRILLRWLFFRGDNNNNGLLRILLRWLFRFG

SEQ ID NO: 2826 - protein, 33 aa, Artificial Sequence
  Antimicrobial peptide sequence
GLVRILLRWLFFRGDNNNNGLPWILLRWLFRRG

SEQ ID NO: 2827 - protein, 34 aa, Artificial Sequence
  Antimicrobial peptide sequence
GLVRILLRWLFFRGDNNNNNGLPWILLRWLFFRG

SEQ ID NO: 2828 - protein, 34 aa, Artificial Sequence
  Antimicrobial peptide sequence
GLVRILLRWLFFRGDNNNNNGLARILLRWLFFRG

SEQ ID NO: 2829 - protein, 34 aa, Artificial Sequence
  Antimicrobial peptide sequence
GLVRILLRWLFFRGDNNNNNGLARILLRWLFRFG

SEQ ID NO: 2830 - protein, 34 aa, Artificial Sequence
  Antimicrobial peptide sequence
GLVRILLRWLFFRGDNNNNNGLVRILLRWLFRFG

SEQ ID NO: 2831 - protein, 34 aa, Artificial Sequence
  Antimicrobial peptide sequence
GLVRILLRWLFFRGDNNNNNGLARILLRLLFFRG

SEQ ID NO: 2832 - protein, 34 aa, Artificial Sequence
  Antimicrobial peptide sequence
GLVRILLRWLFFRGDNNNNNGLARILLRLLFRFG

SEQ ID NO: 2833 - protein, 34 aa, Artificial Sequence
  Antimicrobial peptide sequence
GLVRILLRWLFFRGDNNNNNGLVRILLRLLFRFG

SEQ ID NO: 2834 - protein, 34 aa, Artificial Sequence
  Antimicrobial peptide sequence
GLVRILLRWLFFRGDNNNNNSLVRILLRLLLRFG

SEQ ID NO: 2835 - protein, 34 aa, Artificial Sequence
  Antimicrobial peptide sequence
GLVRILLRWLFFRGDNNNNNGLVRILLRLLLRYG

SEQ ID NO: 2836 - protein, 34 aa, Artificial Sequence
  Antimicrobial peptide sequence
GLVRILLRWLFFRGDNNNNNGLAWILLRWLFFRG

SEQ ID NO: 2837 - protein, 34 aa, Artificial Sequence
  Antimicrobial peptide sequence
GLVRILLRWLFFRGDNNNNNGLVRILLRWLFFRG

SEQ ID NO: 2838 - protein, 34 aa, Artificial Sequence
  Antimicrobial peptide sequence
GLVRILLRWLFFRGDNNNNNGLLRILLRWLFFRG

SEQ ID NO: 2839 - protein, 34 aa, Artificial Sequence
  Antimicrobial peptide sequence
GLVRILLRWLFFRGDNNNNNGLPWILLRWLFRFG

SEQ ID NO: 2840 - protein, 34 aa, Artificial Sequence
  Antimicrobial peptide sequence
GLVRILLRWLFFRGDNNNNNGLLRILLRWLFRFG

SEQ ID NO: 2841 - protein, 34 aa, Artificial Sequence
  Antimicrobial peptide sequence
GLVRILLRWLFFRGDNNNNNGLPWILLRWLFRRG

SEQ ID NO: 2842 - protein, 35 aa, Artificial Sequence
  Antimicrobial peptide sequence
GLVRILLRWLFFRGDNNNNNNGLPWILLRWLFFRG

SEQ ID NO: 2843 - protein, 35 aa, Artificial Sequence
  Antimicrobial peptide sequence
GLVRILLRWLFFRGDNNNNNNGLARILLRWLFFRG

SEQ ID NO: 2844 - protein, 35 aa, Artificial Sequence
  Antimicrobial peptide sequence
GLVRILLRWLFFRGDNNNNNNGLARILLRWLFRFG

SEQ ID NO: 2845 - protein, 35 aa, Artificial Sequence
  Antimicrobial peptide sequence
GLVRILLRWLFFRGDNNNNNNGLVRILLRWLFRFG

SEQ ID NO: 2846 - protein, 35 aa, Artificial Sequence
  Antimicrobial peptide sequence
GLVRILLRWLFFRGDNNNNNNGLARILLRLLFFRG

SEQ ID NO: 2847 - protein, 35 aa, Artificial Sequence
  Antimicrobial peptide sequence
GLVRILLRWLFFRGDNNNNNNGLARILLRLLFRFG

SEQ ID NO: 2848 - protein, 35 aa, Artificial Sequence
  Antimicrobial peptide sequence
GLVRILLRWLFFRGDNNNNNNGLVRILLRLLFRFG

SEQ ID NO: 2849 - protein, 35 aa, Artificial Sequence
  Antimicrobial peptide sequence
GLVRILLRWLFFRGDNNNNNNSLVRILLRLLLRFG

SEQ ID NO: 2850 - protein, 35 aa, Artificial Sequence
  Antimicrobial peptide sequence
GLVRILLRWLFFRGDNNNNNNGLVRILLRLLLRYG

SEQ ID NO: 2851 - protein, 35 aa, Artificial Sequence
  Antimicrobial peptide sequence
GLVRILLRWLFFRGDNNNNNNGLAWILLRWLFFRG

SEQ ID NO: 2852 - protein, 35 aa, Artificial Sequence
  Antimicrobial peptide sequence
GLVRILLRWLFFRGDNNNNNNGLVRILLRWLFFRG

SEQ ID NO: 2853 - protein, 35 aa, Artificial Sequence
  Antimicrobial peptide sequence
GLVRILLRWLFFRGDNNNNNNGLLRILLRWLFFRG

SEQ ID NO: 2854 - protein, 35 aa, Artificial Sequence
  Antimicrobial peptide sequence
GLVRILLRWLFFRGDNNNNNNGLPWILLRWLFRFG

SEQ ID NO: 2855 - protein, 35 aa, Artificial Sequence
  Antimicrobial peptide sequence
GLVRILLRWLFFRGDNNNNNNGLLRILLRWLFRFG

SEQ ID NO: 2856 - protein, 35 aa, Artificial Sequence
  Antimicrobial peptide sequence
GLVRILLRWLFFRGDNNNNNNGLPWILLRWLFRRG

SEQ ID NO: 2857 - protein, 36 aa, Artificial Sequence
  Antimicrobial peptide sequence
GLVRILLRWLFFRGDNNNNNNNGLPWILLRWLFFRG

SEQ ID NO: 2858 - protein, 36 aa, Artificial Sequence
  Antimicrobial peptide sequence
GLVRILLRWLFFRGDNNNNNNNGLARILLRWLFFRG

SEQ ID NO: 2859 - protein, 36 aa, Artificial Sequence
  Antimicrobial peptide sequence
GLVRILLRWLFFRGDNNNNNNNGLARILLRWLFRFG

SEQ ID NO: 2860 - protein, 36 aa, Artificial Sequence
  Antimicrobial peptide sequence
GLVRILLRWLFFRGDNNNNNNNGLVRILLRWLFRFG

SEQ ID NO: 2861 - protein, 36 aa, Artificial Sequence
  Antimicrobial peptide sequence
GLVRILLRWLFFRGDNNNNNNNGLARILLRLLFFRG

SEQ ID NO: 2862 - protein, 36 aa, Artificial Sequence
  Antimicrobial peptide sequence
GLVRILLRWLFFRGDNNNNNNNGLARILLRLLFRFG

SEQ ID NO: 2863 - protein, 36 aa, Artificial Sequence
  Antimicrobial peptide sequence
GLVRILLRWLFFRGDNNNNNNNGLVRILLRLLFRFG

SEQ ID NO: 2864 - protein, 36 aa, Artificial Sequence
  Antimicrobial peptide sequence
GLVRILLRWLFFRGDNNNNNNNSLVRILLRLLLRFG

SEQ ID NO: 2865 - protein, 36 aa, Artificial Sequence
  Antimicrobial peptide sequence
GLVRILLRWLFFRGDNNNNNNNGLVRILLRLLLRYG

SEQ ID NO: 2866 - protein, 36 aa, Artificial Sequence
  Antimicrobial peptide sequence
GLVRILLRWLFFRGDNNNNNNNGLAWILLRWLFFRG

SEQ ID NO: 2867 - protein, 36 aa, Artificial Sequence
  Antimicrobial peptide sequence
GLVRILLRWLFFRGDNNNNNNNGLVRILLRWLFFRG

SEQ ID NO: 2868 - protein, 36 aa, Artificial Sequence
  Antimicrobial peptide sequence
GLVRILLRWLFFRGDNNNNNNNGLLRILLRWLFFRG

SEQ ID NO: 2869 - protein, 36 aa, Artificial Sequence
  Antimicrobial peptide sequence
GLVRILLRWLFFRGDNNNNNNNGLPWILLRWLFRFG

SEQ ID NO: 2870 - protein, 36 aa, Artificial Sequence
  Antimicrobial peptide sequence
GLVRILLRWLFFRGDNNNNNNNGLLRILLRWLFRFG

SEQ ID NO: 2871 - protein, 36 aa, Artificial Sequence
  Antimicrobial peptide sequence
GLVRILLRWLFFRGDNNNNNNNGLPWILLRWLFRRG

SEQ ID NO: 2872 - protein, 35 aa, Artificial Sequence
  Antimicrobial peptide sequence
GLVRILLRWLFFRGDNGNGNGGLPWILLRWLFFRG

SEQ ID NO: 2873 - protein, 35 aa, Artificial Sequence
  Antimicrobial peptide sequence
GLVRILLRWLFFRGDNGNGNGGLARILLRWLFFRG

SEQ ID NO: 2874 - protein, 35 aa, Artificial Sequence
  Antimicrobial peptide sequence
GLVRILLRWLFFRGDNGNGNGGLARILLRWLFRFG

SEQ ID NO: 2875 - protein, 35 aa, Artificial Sequence
  Antimicrobial peptide sequence
GLVRILLRWLFFRGDNGNGNGGLVRILLRWLFRFG

SEQ ID NO: 2876 - protein, 35 aa, Artificial Sequence
  Antimicrobial peptide sequence
GLVRILLRWLFFRGDNGNGNGGLARILLRLLFFRG

SEQ ID NO: 2877 - protein, 35 aa, Artificial Sequence
  Antimicrobial peptide sequence
GLVRILLRWLFFRGDNGNGNGGLARILLRLLFRFG

SEQ ID NO: 2878 - protein, 35 aa, Artificial Sequence
  Antimicrobial peptide sequence
GLVRILLRWLFFRGDNGNGNGGLVRILLRLLFRFG

SEQ ID NO: 2879 - protein, 35 aa, Artificial Sequence
  Antimicrobial peptide sequence
GLVRILLRWLFFRGDNGNGNGSLVRILLRLLLRFG

SEQ ID NO: 2880 - protein, 35 aa, Artificial Sequence
  Antimicrobial peptide sequence
GLVRILLRWLFFRGDNGNGNGGLVRILLRLLLRYG

SEQ ID NO: 2881 - protein, 35 aa, Artificial Sequence
  Antimicrobial peptide sequence
GLVRILLRWLFFRGDNGNGNGGLAWILLRWLFFRG

SEQ ID NO: 2882 - protein, 35 aa, Artificial Sequence
  Antimicrobial peptide sequence
GLVRILLRWLFFRGDNGNGNGGLVRILLRWLFFRG

SEQ ID NO: 2883 - protein, 35 aa, Artificial Sequence
  Antimicrobial peptide sequence
GLVRILLRWLFFRGDNGNGNGGLLRILLRWLFFRG

SEQ ID NO: 2884 - protein, 35 aa, Artificial Sequence
  Antimicrobial peptide sequence
GLVRILLRWLFFRGDNGNGNGGLPWILLRWLFRFG

SEQ ID NO: 2885 - protein, 35 aa, Artificial Sequence
  Antimicrobial peptide sequence
GLVRILLRWLFFRGDNGNGNGGLLRILLRWLFRFG

SEQ ID NO: 2886 - protein, 35 aa, Artificial Sequence
  Antimicrobial peptide sequence
GLVRILLRWLFFRGDNGNGNGGLPWILLRWLFRRG

SEQ ID NO: 2887 - protein, 35 aa, Artificial Sequence
  Antimicrobial peptide sequence
GLVRILLRWLFFRGDGNGNGNGLPWILLRWLFFRG

SEQ ID NO: 2888 - protein, 35 aa, Artificial Sequence
  Antimicrobial peptide sequence
GLVRILLRWLFFRGDGNGNGNGLARILLRWLFFRG

SEQ ID NO: 2889 - protein, 35 aa, Artificial Sequence
  Antimicrobial peptide sequence
GLVRILLRWLFFRGDGNGNGNGLARILLRWLFRFG

SEQ ID NO: 2890 - protein, 35 aa, Artificial Sequence
  Antimicrobial peptide sequence
GLVRILLRWLFFRGDGNGNGNGLVRILLRWLFRFG

SEQ ID NO: 2891 - protein, 35 aa, Artificial Sequence
  Antimicrobial peptide sequence
GLVRILLRWLFFRGDGNGNGNGLARILLRLLFFRG

SEQ ID NO: 2892 - protein, 35 aa, Artificial Sequence
  Antimicrobial peptide sequence
GLVRILLRWLFFRGDGNGNGNGLARILLRLLFRFG

SEQ ID NO: 2893 - protein, 35 aa, Artificial Sequence
  Antimicrobial peptide sequence
GLVRILLRWLFFRGDGNGNGNGLVRILLRLLFRFG

SEQ ID NO: 2894 - protein, 35 aa, Artificial Sequence
  Antimicrobial peptide sequence
GLVRILLRWLFFRGDGNGNGNSLVRILLRLLLRFG

SEQ ID NO: 2895 - protein, 35 aa, Artificial Sequence
  Antimicrobial peptide sequence
GLVRILLRWLFFRGDGNGNGNGLVRILLRLLLRYG

SEQ ID NO: 2896 - protein, 35 aa, Artificial Sequence
  Antimicrobial peptide sequence
GLVRILLRWLFFRGDGNGNGNGLAWILLRWLFFRG

SEQ ID NO: 2897 - protein, 35 aa, Artificial Sequence
  Antimicrobial peptide sequence
GLVRILLRWLFFRGDGNGNGNGLVRILLRWLFFRG

SEQ ID NO: 2898 - protein, 35 aa, Artificial Sequence
  Antimicrobial peptide sequence
GLVRILLRWLFFRGDGNGNGNGLLRILLRWLFFRG

SEQ ID NO: 2899 - protein, 35 aa, Artificial Sequence
  Antimicrobial peptide sequence
GLVRILLRWLFFRGDGNGNGNGLPWILLRWLFRFG

SEQ ID NO: 2900 - protein, 35 aa, Artificial Sequence
  Antimicrobial peptide sequence
GLVRILLRWLFFRGDGNGNGNGLLRILLRWLFRFG

SEQ ID NO: 2901 - protein, 35 aa, Artificial Sequence
  Antimicrobial peptide sequence
GLVRILLRWLFFRGDGNGNGNGLPWILLRWLFRRG

SEQ ID NO: 2902 - protein, 35 aa, Artificial Sequence
  Antimicrobial peptide sequence
GLVRILLRWLFFRGDSGSGSGGLPWILLRWLFFRG

SEQ ID NO: 2903 - protein, 35 aa, Artificial Sequence
  Antimicrobial peptide sequence
GLVRILLRWLFFRGDSGSGSGGLARILLRWLFFRG

SEQ ID NO: 2904 - protein, 35 aa, Artificial Sequence
  Antimicrobial peptide sequence
GLVRILLRWLFFRGDSGSGSGGLARILLRWLFRFG

SEQ ID NO: 2905 - protein, 35 aa, Artificial Sequence
  Antimicrobial peptide sequence
GLVRILLRWLFFRGDSGSGSGGLVRILLRWLFRFG

SEQ ID NO: 2906 - protein, 35 aa, Artificial Sequence
  Antimicrobial peptide sequence
GLVRILLRWLFFRGDSGSGSGGLARILLRLLFFRG

SEQ ID NO: 2907 - protein, 35 aa, Artificial Sequence
  Antimicrobial peptide sequence
GLVRILLRWLFFRGDSGSGSGGLARILLRLLFRFG

SEQ ID NO: 2908 - protein, 35 aa, Artificial Sequence
  Antimicrobial peptide sequence
GLVRILLRWLFFRGDSGSGSGGLVRILLRLLFRFG

SEQ ID NO: 2909 - protein, 35 aa, Artificial Sequence
  Antimicrobial peptide sequence
GLVRILLRWLFFRGDSGSGSGSLVRILLRLLLRFG

SEQ ID NO: 2910 - protein, 35 aa, Artificial Sequence
  Antimicrobial peptide sequence
GLVRILLRWLFFRGDSGSGSGGLVRILLRLLLRYG

SEQ ID NO: 2911 - protein, 35 aa, Artificial Sequence
  Antimicrobial peptide sequence
GLVRILLRWLFFRGDSGSGSGGLAWILLRWLFFRG

SEQ ID NO: 2912 - protein, 35 aa, Artificial Sequence
  Antimicrobial peptide sequence
GLVRILLRWLFFRGDSGSGSGGLVRILLRWLFFRG

SEQ ID NO: 2913 - protein, 35 aa, Artificial Sequence
  Antimicrobial peptide sequence
GLVRILLRWLFFRGDSGSGSGGLLRILLRWLFFRG

SEQ ID NO: 2914 - protein, 35 aa, Artificial Sequence
  Antimicrobial peptide sequence
GLVRILLRWLFFRGDSGSGSGGLPWILLRWLFRFG

SEQ ID NO: 2915 - protein, 35 aa, Artificial Sequence
  Antimicrobial peptide sequence
GLVRILLRWLFFRGDSGSGSGGLLRILLRWLFRFG

SEQ ID NO: 2916 - protein, 35 aa, Artificial Sequence
  Antimicrobial peptide sequence
GLVRILLRWLFFRGDSGSGSGGLPWILLRWLFRRG

SEQ ID NO: 2917 - protein, 35 aa, Artificial Sequence
  Antimicrobial peptide sequence
GLVRILLRWLFFRGDGSGSGSGLPWILLRWLFFRG

SEQ ID NO: 2918 - protein, 35 aa, Artificial Sequence
  Antimicrobial peptide sequence
GLVRILLRWLFFRGDGSGSGSGLARILLRWLFFRG

SEQ ID NO: 2919 - protein, 35 aa, Artificial Sequence
  Antimicrobial peptide sequence
GLVRILLRWLFFRGDGSGSGSGLARILLRWLFRFG

SEQ ID NO: 2920 - protein, 35 aa, Artificial Sequence
  Antimicrobial peptide sequence
GLVRILLRWLFFRGDGSGSGSGLVRILLRWLFRFG

SEQ ID NO: 2921 - protein, 35 aa, Artificial Sequence
  Antimicrobial peptide sequence
GLVRILLRWLFFRGDGSGSGSGLARILLRLLFFRG

SEQ ID NO: 2922 - protein, 35 aa, Artificial Sequence
  Antimicrobial peptide sequence
GLVRILLRWLFFRGDGSGSGSGLARILLRLLFRFG

SEQ ID NO: 2923 - protein, 35 aa, Artificial Sequence
  Antimicrobial peptide sequence
GLVRILLRWLFFRGDGSGSGSGLVRILLRLLFRFG

SEQ ID NO: 2924 - protein, 35 aa, Artificial Sequence
  Antimicrobial peptide sequence
GLVRILLRWLFFRGDGSGSGSSLVRILLRLLLRFG

SEQ ID NO: 2925 - protein, 35 aa, Artificial Sequence
  Antimicrobial peptide sequence
GLVRILLRWLFFRGDGSGSGSGLVRILLRLLLRYG

SEQ ID NO: 2926 - protein, 35 aa, Artificial Sequence
  Antimicrobial peptide sequence
GLVRILLRWLFFRGDGSGSGSGLAWILLRWLFFRG

SEQ ID NO: 2927 - protein, 35 aa, Artificial Sequence
  Antimicrobial peptide sequence
GLVRILLRWLFFRGDGSGSGSGLVRILLRWLFFRG

SEQ ID NO: 2928 - protein, 35 aa, Artificial Sequence
  Antimicrobial peptide sequence
GLVRILLRWLFFRGDGSGSGSGLLRILLRWLFFRG

SEQ ID NO: 2929 - protein, 35 aa, Artificial Sequence
  Antimicrobial peptide sequence
GLVRILLRWLFFRGDGSGSGSGLPWILLRWLFRFG

SEQ ID NO: 2930 - protein, 35 aa, Artificial Sequence
  Antimicrobial peptide sequence
GLVRILLRWLFFRGDGSGSGSGLLRILLRWLFRFG

SEQ ID NO: 2931 - protein, 35 aa, Artificial Sequence
  Antimicrobial peptide sequence
GLVRILLRWLFFRGDGSGSGSGLPWILLRWLFRRG

SEQ ID NO: 2932 - protein, 35 aa, Artificial Sequence
  Antimicrobial peptide sequence
GLVRILLRWLFFRGDSNSNSNGLPWILLRWLFFRG

SEQ ID NO: 2933 - protein, 35 aa, Artificial Sequence
  Antimicrobial peptide sequence
GLVRILLRWLFFRGDSNSNSNGLARILLRWLFFRG

SEQ ID NO: 2934 - protein, 35 aa, Artificial Sequence
  Antimicrobial peptide sequence
GLVRILLRWLFFRGDSNSNSNGLARILLRWLFRFG

SEQ ID NO: 2935 - protein, 35 aa, Artificial Sequence
  Antimicrobial peptide sequence
GLVRILLRWLFFRGDSNSNSNGLVRILLRWLFRFG

SEQ ID NO: 2936 - protein, 35 aa, Artificial Sequence
  Antimicrobial peptide sequence
GLVRILLRWLFFRGDSNSNSNGLARILLRLLFFRG

SEQ ID NO: 2937 - protein, 35 aa, Artificial Sequence
  Antimicrobial peptide sequence
GLVRILLRWLFFRGDSNSNSNGLARILLRLLFRFG

SEQ ID NO: 2938 - protein, 35 aa, Artificial Sequence
  Antimicrobial peptide sequence
GLVRILLRWLFFRGDSNSNSNGLVRILLRLLFRFG

SEQ ID NO: 2939 - protein, 35 aa, Artificial Sequence
  Antimicrobial peptide sequence
GLVRILLRWLFFRGDSNSNSNSLVRILLRLLLRFG

SEQ ID NO: 2940 - protein, 35 aa, Artificial Sequence
  Antimicrobial peptide sequence
GLVRILLRWLFFRGDSNSNSNGLVRILLRLLLRYG

SEQ ID NO: 2941 - protein, 35 aa, Artificial Sequence
  Antimicrobial peptide sequence
GLVRILLRWLFFRGDSNSNSNGLAWILLRWLFFRG

SEQ ID NO: 2942 - protein, 35 aa, Artificial Sequence
  Antimicrobial peptide sequence
GLVRILLRWLFFRGDSNSNSNGLVRILLRWLFFRG

SEQ ID NO: 2943 - protein, 35 aa, Artificial Sequence
  Antimicrobial peptide sequence
GLVRILLRWLFFRGDSNSNSNGLLRILLRWLFFRG

SEQ ID NO: 2944 - protein, 35 aa, Artificial Sequence
  Antimicrobial peptide sequence
GLVRILLRWLFFRGDSNSNSNGLPWILLRWLFRFG

SEQ ID NO: 2945 - protein, 35 aa, Artificial Sequence
  Antimicrobial peptide sequence
GLVRILLRWLFFRGDSNSNSNGLLRILLRWLFRFG

SEQ ID NO: 2946 - protein, 35 aa, Artificial Sequence
  Antimicrobial peptide sequence
GLVRILLRWLFFRGDSNSNSNGLPWILLRWLFRRG

SEQ ID NO: 2947 - protein, 35 aa, Artificial Sequence
  Antimicrobial peptide sequence
GLVRILLRWLFFRGDNSNSNSGLPWILLRWLFFRG

SEQ ID NO: 2948 - protein, 35 aa, Artificial Sequence
  Antimicrobial peptide sequence
GLVRILLRWLFFRGDNSNSNSGLARILLRWLFFRG

SEQ ID NO: 2949 - protein, 35 aa, Artificial Sequence
  Antimicrobial peptide sequence
GLVRILLRWLFFRGDNSNSNSGLARILLRWLFRFG

SEQ ID NO: 2950 - protein, 35 aa, Artificial Sequence
  Antimicrobial peptide sequence
GLVRILLRWLFFRGDNSNSNSGLVRILLRWLFRFG

SEQ ID NO: 2951 - protein, 35 aa, Artificial Sequence
  Antimicrobial peptide sequence
GLVRILLRWLFFRGDNSNSNSGLARILLRLLFFRG

SEQ ID NO: 2952 - protein, 35 aa, Artificial Sequence
  Antimicrobial peptide sequence
GLVRILLRWLFFRGDNSNSNSGLARILLRLLFRFG

SEQ ID NO: 2953 - protein, 35 aa, Artificial Sequence
  Antimicrobial peptide sequence
GLVRILLRWLFFRGDNSNSNSGLVRILLRLLFRFG

SEQ ID NO: 2954 - protein, 35 aa, Artificial Sequence
  Antimicrobial peptide sequence
GLVRILLRWLFFRGDNSNSNSSLVRILLRLLLRFG

SEQ ID NO: 2955 - protein, 35 aa, Artificial Sequence
  Antimicrobial peptide sequence
GLVRILLRWLFFRGDNSNSNSGLVRILLRLLLRYG

SEQ ID NO: 2956 - protein, 35 aa, Artificial Sequence
  Antimicrobial peptide sequence
GLVRILLRWLFFRGDNSNSNSGLAWILLRWLFFRG

SEQ ID NO: 2957 - protein, 35 aa, Artificial Sequence
  Antimicrobial peptide sequence
GLVRILLRWLFFRGDNSNSNSGLVRILLRWLFFRG

SEQ ID NO: 2958 - protein, 35 aa, Artificial Sequence
  Antimicrobial peptide sequence
GLVRILLRWLFFRGDNSNSNSGLLRILLRWLFFRG

SEQ ID NO: 2959 - protein, 35 aa, Artificial Sequence
  Antimicrobial peptide sequence
GLVRILLRWLFFRGDNSNSNSGLPWILLRWLFRFG

SEQ ID NO: 2960 - protein, 35 aa, Artificial Sequence
  Antimicrobial peptide sequence
GLVRILLRWLFFRGDNSNSNSGLLRILLRWLFRFG

SEQ ID NO: 2961 - protein, 35 aa, Artificial Sequence
  Antimicrobial peptide sequence
GLVRILLRWLFFRGDNSNSNSGLPWILLRWLFRRG

SEQ ID NO: 2962 - protein, 35 aa, Artificial Sequence
  Antimicrobial peptide sequence
GLVRILLRWLFFRGDHGHGHGGLPWILLRWLFFRG

SEQ ID NO: 2963 - protein, 35 aa, Artificial Sequence
  Antimicrobial peptide sequence
GLVRILLRWLFFRGDHGHGHGGLARILLRWLFFRG

SEQ ID NO: 2964 - protein, 35 aa, Artificial Sequence
  Antimicrobial peptide sequence
GLVRILLRWLFFRGDHGHGHGGLARILLRWLFRFG

SEQ ID NO: 2965 - protein, 35 aa, Artificial Sequence
  Antimicrobial peptide sequence
GLVRILLRWLFFRGDHGHGHGGLVRILLRWLFRFG

SEQ ID NO: 2966 - protein, 35 aa, Artificial Sequence
  Antimicrobial peptide sequence
GLVRILLRWLFFRGDHGHGHGGLARILLRLLFFRG

SEQ ID NO: 2967 - protein, 35 aa, Artificial Sequence
  Antimicrobial peptide sequence
GLVRILLRWLFFRGDHGHGHGGLARILLRLLFRFG

SEQ ID NO: 2968 - protein, 35 aa, Artificial Sequence
  Antimicrobial peptide sequence
GLVRILLRWLFFRGDHGHGHGGLVRILLRLLFRFG

SEQ ID NO: 2969 - protein, 35 aa, Artificial Sequence
  Antimicrobial peptide sequence
GLVRILLRWLFFRGDHGHGHGSLVRILLRLLLRFG

SEQ ID NO: 2970 - protein, 35 aa, Artificial Sequence
  Antimicrobial peptide sequence
GLVRILLRWLFFRGDHGHGHGGLVRILLRLLLRYG

SEQ ID NO: 2971 - protein, 35 aa, Artificial Sequence
  Antimicrobial peptide sequence
GLVRILLRWLFFRGDHGHGHGGLAWILLRWLFFRG

SEQ ID NO: 2972 - protein, 35 aa, Artificial Sequence
  Antimicrobial peptide sequence
GLVRILLRWLFFRGDHGHGHGGLVRILLRWLFFRG

SEQ ID NO: 2973 - protein, 35 aa, Artificial Sequence
  Antimicrobial peptide sequence
GLVRILLRWLFFRGDHGHGHGGLLRILLRWLFFRG

SEQ ID NO: 2974 - protein, 35 aa, Artificial Sequence
  Antimicrobial peptide sequence
GLVRILLRWLFFRGDHGHGHGGLPWILLRWLFRFG

SEQ ID NO: 2975 - protein, 35 aa, Artificial Sequence
  Antimicrobial peptide sequence
GLVRILLRWLFFRGDHGHGHGGLLRILLRWLFRFG

SEQ ID NO: 2976 - protein, 35 aa, Artificial Sequence
  Antimicrobial peptide sequence
GLVRILLRWLFFRGDHGHGHGGLPWILLRWLFRRG

SEQ ID NO: 2977 - protein, 35 aa, Artificial Sequence
  Antimicrobial peptide sequence
GLVRILLRWLFFRGDGHGHGHGLPWILLRWLFFRG

SEQ ID NO: 2978 - protein, 35 aa, Artificial Sequence
  Antimicrobial peptide sequence
GLVRILLRWLFFRGDGHGHGHGLARILLRWLFFRG

SEQ ID NO: 2979 - protein, 35 aa, Artificial Sequence
  Antimicrobial peptide sequence
GLVRILLRWLFFRGDGHGHGHGLARILLRWLFRFG

SEQ ID NO: 2980 - protein, 35 aa, Artificial Sequence
  Antimicrobial peptide sequence
GLVRILLRWLFFRGDGHGHGHGLVRILLRWLFRFG

SEQ ID NO: 2981 - protein, 35 aa, Artificial Sequence
  Antimicrobial peptide sequence
GLVRILLRWLFFRGDGHGHGHGLARILLRLLFFRG

SEQ ID NO: 2982 - protein, 35 aa, Artificial Sequence
  Antimicrobial peptide sequence
GLVRILLRWLFFRGDGHGHGHGLARILLRLLFRFG

SEQ ID NO: 2983 - protein, 35 aa, Artificial Sequence
  Antimicrobial peptide sequence
GLVRILLRWLFFRGDGHGHGHGLVRILLRLLFRFG

SEQ ID NO: 2984 - protein, 35 aa, Artificial Sequence
  Antimicrobial peptide sequence
GLVRILLRWLFFRGDGHGHGHSLVRILLRLLLRFG

SEQ ID NO: 2985 - protein, 35 aa, Artificial Sequence
  Antimicrobial peptide sequence
GLVRILLRWLFFRGDGHGHGHGLVRILLRLLLRYG

SEQ ID NO: 2986 - protein, 35 aa, Artificial Sequence
  Antimicrobial peptide sequence
GLVRILLRWLFFRGDGHGHGHGLAWILLRWLFFRG

SEQ ID NO: 2987 - protein, 35 aa, Artificial Sequence
  Antimicrobial peptide sequence
GLVRILLRWLFFRGDGHGHGHGLVRILLRWLFFRG

SEQ ID NO: 2988 - protein, 35 aa, Artificial Sequence
  Antimicrobial peptide sequence
GLVRILLRWLFFRGDGHGHGHGLLRILLRWLFFRG

SEQ ID NO: 2989 - protein, 35 aa, Artificial Sequence
  Antimicrobial peptide sequence
GLVRILLRWLFFRGDGHGHGHGLPWILLRWLFRFG

SEQ ID NO: 2990 - protein, 35 aa, Artificial Sequence
  Antimicrobial peptide sequence
GLVRILLRWLFFRGDGHGHGHGLLRILLRWLFRFG

SEQ ID NO: 2991 - protein, 35 aa, Artificial Sequence
  Antimicrobial peptide sequence
GLVRILLRWLFFRGDGHGHGHGLPWILLRWLFRRG

SEQ ID NO: 2992 - protein, 35 aa, Artificial Sequence
  Antimicrobial peptide sequence
GLVRILLRWLFFRGDHNHNHNGLPWILLRWLFFRG

SEQ ID NO: 2993 - protein, 35 aa, Artificial Sequence
  Antimicrobial peptide sequence
GLVRILLRWLFFRGDHNHNHNGLARILLRWLFFRG

SEQ ID NO: 2994 - protein, 35 aa, Artificial Sequence
  Antimicrobial peptide sequence
GLVRILLRWLFFRGDHNHNHNGLARILLRWLFRFG

SEQ ID NO: 2995 - protein, 35 aa, Artificial Sequence
  Antimicrobial peptide sequence
GLVRILLRWLFFRGDHNHNHNGLVRILLRWLFRFG

SEQ ID NO: 2996 - protein, 35 aa, Artificial Sequence
  Antimicrobial peptide sequence
GLVRILLRWLFFRGDHNHNHNGLARILLRLLFFRG

SEQ ID NO: 2997 - protein, 35 aa, Artificial Sequence
  Antimicrobial peptide sequence
GLVRILLRWLFFRGDHNHNHNGLARILLRLLFRFG

SEQ ID NO: 2998 - protein, 35 aa, Artificial Sequence
  Antimicrobial peptide sequence
GLVRILLRWLFFRGDHNHNHNGLVRILLRLLFRFG

SEQ ID NO: 2999 - protein, 35 aa, Artificial Sequence
  Antimicrobial peptide sequence
GLVRILLRWLFFRGDHNHNHNSLVRILLRLLLRFG

SEQ ID NO: 3000 - protein, 35 aa, Artificial Sequence
  Antimicrobial peptide sequence
GLVRILLRWLFFRGDHNHNHNGLVRILLRLLLRYG

SEQ ID NO: 3001 - protein, 35 aa, Artificial Sequence
  Antimicrobial peptide sequence
GLVRILLRWLFFRGDHNHNHNGLAWILLRWLFFRG

SEQ ID NO: 3002 - protein, 35 aa, Artificial Sequence
  Antimicrobial peptide sequence
GLVRILLRWLFFRGDHNHNHNGLVRILLRWLFFRG

SEQ ID NO: 3003 - protein, 35 aa, Artificial Sequence
  Antimicrobial peptide sequence
GLVRILLRWLFFRGDHNHNHNGLLRILLRWLFFRG

SEQ ID NO: 3004 - protein, 35 aa, Artificial Sequence
  Antimicrobial peptide sequence
GLVRILLRWLFFRGDHNHNHNGLPWILLRWLFRFG

SEQ ID NO: 3005 - protein, 35 aa, Artificial Sequence
  Antimicrobial peptide sequence
GLVRILLRWLFFRGDHNHNHNGLLRILLRWLFRFG

SEQ ID NO: 3006 - protein, 35 aa, Artificial Sequence
  Antimicrobial peptide sequence
GLVRILLRWLFFRGDHNHNHNGLPWILLRWLFRRG

SEQ ID NO: 3007 - protein, 35 aa, Artificial Sequence
  Antimicrobial peptide sequence
GLVRILLRWLFFRGDNHNHNHGLPWILLRWLFFRG

SEQ ID NO: 3008 - protein, 35 aa, Artificial Sequence
  Antimicrobial peptide sequence
GLVRILLRWLFFRGDNHNHNHGLARILLRWLFFRG

SEQ ID NO: 3009 - protein, 35 aa, Artificial Sequence
  Antimicrobial peptide sequence
GLVRILLRWLFFRGDNHNHNHGLARILLRWLFRFG

SEQ ID NO: 3010 - protein, 35 aa, Artificial Sequence
  Antimicrobial peptide sequence
GLVRILLRWLFFRGDNHNHNHGLVRILLRWLFRFG

SEQ ID NO: 3011 - protein, 35 aa, Artificial Sequence
  Antimicrobial peptide sequence
GLVRILLRWLFFRGDNHNHNHGLARILLRLLFFRG

SEQ ID NO: 3012 - protein, 35 aa, Artificial Sequence
  Antimicrobial peptide sequence
GLVRILLRWLFFRGDNHNHNHGLARILLRLLFRFG

SEQ ID NO: 3013 - protein, 35 aa, Artificial Sequence
  Antimicrobial peptide sequence
GLVRILLRWLFFRGDNHNHNHGLVRILLRLLFRFG

SEQ ID NO: 3014 - protein, 35 aa, Artificial Sequence
  Antimicrobial peptide sequence
GLVRILLRWLFFRGDNHNHNHSLVRILLRLLLRFG

SEQ ID NO: 3015 - protein, 35 aa, Artificial Sequence
  Antimicrobial peptide sequence
GLVRILLRWLFFRGDNHNHNHGLVRILLRLLLRYG

SEQ ID NO: 3016 - protein, 35 aa, Artificial Sequence
  Antimicrobial peptide sequence
GLVRILLRWLFFRGDNHNHNHGLAWILLRWLFFRG

SEQ ID NO: 3017 - protein, 35 aa, Artificial Sequence
  Antimicrobial peptide sequence
GLVRILLRWLFFRGDNHNHNHGLVRILLRWLFFRG

SEQ ID NO: 3018 - protein, 35 aa, Artificial Sequence
  Antimicrobial peptide sequence
GLVRILLRWLFFRGDNHNHNHGLLRILLRWLFFRG

SEQ ID NO: 3019 - protein, 35 aa, Artificial Sequence
  Antimicrobial peptide sequence
GLVRILLRWLFFRGDNHNHNHGLPWILLRWLFRFG

SEQ ID NO: 3020 - protein, 35 aa, Artificial Sequence
  Antimicrobial peptide sequence
GLVRILLRWLFFRGDNHNHNHGLLRILLRWLFRFG

SEQ ID NO: 3021 - protein, 35 aa, Artificial Sequence
  Antimicrobial peptide sequence
GLVRILLRWLFFRGDNHNHNHGLPWILLRWLFRRG

SEQ ID NO: 3022 - protein, 33 aa, Artificial Sequence
  Antimicrobial peptide sequence
GLLRILLRWLFFRGDGGGGGLPWILLRWLFFRG

SEQ ID NO: 3023 - protein, 33 aa, Artificial Sequence
  Antimicrobial peptide sequence
GLLRILLRWLFFRGDGGGGGLARILLRWLFFRG

SEQ ID NO: 3024 - protein, 33 aa, Artificial Sequence
  Antimicrobial peptide sequence
GLLRILLRWLFFRGDGGGGGLARILLRWLFRFG

SEQ ID NO: 3025 - protein, 33 aa, Artificial Sequence
  Antimicrobial peptide sequence
GLLRILLRWLFFRGDGGGGGLVRILLRWLFRFG

SEQ ID NO: 3026 - protein, 33 aa, Artificial Sequence
  Antimicrobial peptide sequence
GLLRILLRWLFFRGDGGGGGLARILLRLLFFRG

SEQ ID NO: 3027 - protein, 33 aa, Artificial Sequence
  Antimicrobial peptide sequence
GLLRILLRWLFFRGDGGGGGLARILLRLLFRFG

SEQ ID NO: 3028 - protein, 33 aa, Artificial Sequence
  Antimicrobial peptide sequence
GLLRILLRWLFFRGDGGGGGLVRILLRLLFRFG

SEQ ID NO: 3029 - protein, 33 aa, Artificial Sequence
  Antimicrobial peptide sequence
GLLRILLRWLFFRGDGGGGSLVRILLRLLLRFG

SEQ ID NO: 3030 - protein, 33 aa, Artificial Sequence
  Antimicrobial peptide sequence
GLLRILLRWLFFRGDGGGGGLVRILLRLLLRYG

SEQ ID NO: 3031 - protein, 33 aa, Artificial Sequence
  Antimicrobial peptide sequence
GLLRILLRWLFFRGDGGGGGLAWILLRWLFFRG

SEQ ID NO: 3032 - protein, 33 aa, Artificial Sequence
  Antimicrobial peptide sequence
GLLRILLRWLFFRGDGGGGGLVRILLRWLFFRG

SEQ ID NO: 3033 - protein, 33 aa, Artificial Sequence
  Antimicrobial peptide sequence
GLLRILLRWLFFRGDGGGGGLLRILLRWLFFRG

SEQ ID NO: 3034 - protein, 33 aa, Artificial Sequence
  Antimicrobial peptide sequence
GLLRILLRWLFFRGDGGGGGLPWILLRWLFRFG

SEQ ID NO: 3035 - protein, 33 aa, Artificial Sequence
  Antimicrobial peptide sequence
GLLRILLRWLFFRGDGGGGGLLRILLRWLFRFG

SEQ ID NO: 3036 - protein, 33 aa, Artificial Sequence
  Antimicrobial peptide sequence
GLLRILLRWLFFRGDGGGGGLPWILLRWLFRRG

SEQ ID NO: 3037 - protein, 34 aa, Artificial Sequence
  Antimicrobial peptide sequence
GLLRILLRWLFFRGDGGGGGGLPWILLRWLFFRG

SEQ ID NO: 3038 - protein, 34 aa, Artificial Sequence
  Antimicrobial peptide sequence
GLLRILLRWLFFRGDGGGGGGLARILLRWLFFRG

SEQ ID NO: 3039 - protein, 34 aa, Artificial Sequence
  Antimicrobial peptide sequence
GLLRILLRWLFFRGDGGGGGGLARILLRWLFRFG

SEQ ID NO: 3040 - protein, 34 aa, Artificial Sequence
  Antimicrobial peptide sequence
GLLRILLRWLFFRGDGGGGGGLVRILLRWLFRFG

SEQ ID NO: 3041 - protein, 34 aa, Artificial Sequence
  Antimicrobial peptide sequence
GLLRILLRWLFFRGDGGGGGGLARILLRLLFFRG

SEQ ID NO: 3042 - protein, 34 aa, Artificial Sequence
  Antimicrobial peptide sequence
GLLRILLRWLFFRGDGGGGGGLARILLRLLFRFG

SEQ ID NO: 3043 - protein, 34 aa, Artificial Sequence
  Antimicrobial peptide sequence
GLLRILLRWLFFRGDGGGGGGLVRILLRLLFRFG

SEQ ID NO: 3044 - protein, 34 aa, Artificial Sequence
  Antimicrobial peptide sequence
GLLRILLRWLFFRGDGGGGGSLVRILLRLLLRFG

SEQ ID NO: 3045 - protein, 34 aa, Artificial Sequence
  Antimicrobial peptide sequence
GLLRILLRWLFFRGDGGGGGGLVRILLRLLLRYG

SEQ ID NO: 3046 - protein, 34 aa, Artificial Sequence
  Antimicrobial peptide sequence
GLLRILLRWLFFRGDGGGGGGLAWILLRWLFFRG

SEQ ID NO: 3047 - protein, 34 aa, Artificial Sequence
  Antimicrobial peptide sequence
GLLRILLRWLFFRGDGGGGGGLVRILLRWLFFRG

SEQ ID NO: 3048 - protein, 34 aa, Artificial Sequence
  Antimicrobial peptide sequence
GLLRILLRWLFFRGDGGGGGGLLRILLRWLFFRG

SEQ ID NO: 3049 - protein, 34 aa, Artificial Sequence
  Antimicrobial peptide sequence
GLLRILLRWLFFRGDGGGGGGLPWILLRWLFRFG

SEQ ID NO: 3050 - protein, 34 aa, Artificial Sequence
  Antimicrobial peptide sequence
GLLRILLRWLFFRGDGGGGGGLLRILLRWLFRFG

SEQ ID NO: 3051 - protein, 34 aa, Artificial Sequence
  Antimicrobial peptide sequence
GLLRILLRWLFFRGDGGGGGGLPWILLRWLFRRG

SEQ ID NO: 3052 - protein, 35 aa, Artificial Sequence
  Antimicrobial peptide sequence
GLLRILLRWLFFRGDGGGGGGGLPWILLRWLFFRG

SEQ ID NO: 3053 - protein, 35 aa, Artificial Sequence
  Antimicrobial peptide sequence
GLLRILLRWLFFRGDGGGGGGGLARILLRWLFFRG

SEQ ID NO: 3054 - protein, 35 aa, Artificial Sequence
  Antimicrobial peptide sequence
GLLRILLRWLFFRGDGGGGGGGLARILLRWLFRFG

SEQ ID NO: 3055 - protein, 35 aa, Artificial Sequence
  Antimicrobial peptide sequence
GLLRILLRWLFFRGDGGGGGGGLVRILLRWLFRFG

SEQ ID NO: 3056 - protein, 35 aa, Artificial Sequence
  Antimicrobial peptide sequence
GLLRILLRWLFFRGDGGGGGGGLARILLRLLFFRG

SEQ ID NO: 3057 - protein, 35 aa, Artificial Sequence
  Antimicrobial peptide sequence
GLLRILLRWLFFRGDGGGGGGGLARILLRLLFRFG

SEQ ID NO: 3058 - protein, 35 aa, Artificial Sequence
  Antimicrobial peptide sequence
GLLRILLRWLFFRGDGGGGGGGLVRILLRLLFRFG

SEQ ID NO: 3059 - protein, 35 aa, Artificial Sequence
  Antimicrobial peptide sequence
GLLRILLRWLFFRGDGGGGGGSLVRILLRLLLRFG

SEQ ID NO: 3060 - protein, 35 aa, Artificial Sequence
  Antimicrobial peptide sequence
GLLRILLRWLFFRGDGGGGGGGLVRILLRLLLRYG

SEQ ID NO: 3061 - protein, 35 aa, Artificial Sequence
  Antimicrobial peptide sequence
GLLRILLRWLFFRGDGGGGGGGLAWILLRWLFFRG

SEQ ID NO: 3062 - protein, 35 aa, Artificial Sequence
  Antimicrobial peptide sequence
GLLRILLRWLFFRGDGGGGGGGLVRILLRWLFFRG

SEQ ID NO: 3063 - protein, 35 aa, Artificial Sequence
  Antimicrobial peptide sequence
GLLRILLRWLFFRGDGGGGGGGLLRILLRWLFFRG

SEQ ID NO: 3064 - protein, 35 aa, Artificial Sequence
  Antimicrobial peptide sequence
GLLRILLRWLFFRGDGGGGGGGLPWILLRWLFRFG

SEQ ID NO: 3065 - protein, 35 aa, Artificial Sequence
  Antimicrobial peptide sequence
GLLRILLRWLFFRGDGGGGGGGLLRILLRWLFRFG

SEQ ID NO: 3066 - protein, 35 aa, Artificial Sequence
  Antimicrobial peptide sequence
GLLRILLRWLFFRGDGGGGGGGLPWILLRWLFRRG

SEQ ID NO: 3067 - protein, 36 aa, Artificial Sequence
  Antimicrobial peptide sequence
GLLRILLRWLFFRGDGGGGGGGGLPWILLRWLFFRG

SEQ ID NO: 3068 - protein, 36 aa, Artificial Sequence
  Antimicrobial peptide sequence
GLLRILLRWLFFRGDGGGGGGGGLARILLRWLFFRG

SEQ ID NO: 3069 - protein, 36 aa, Artificial Sequence
  Antimicrobial peptide sequence
GLLRILLRWLFFRGDGGGGGGGGLARILLRWLFRFG

SEQ ID NO: 3070 - protein, 36 aa, Artificial Sequence
  Antimicrobial peptide sequence
GLLRILLRWLFFRGDGGGGGGGGLVRILLRWLFRFG

SEQ ID NO: 3071 - protein, 36 aa, Artificial Sequence
  Antimicrobial peptide sequence
GLLRILLRWLFFRGDGGGGGGGGLARILLRLLFFRG

SEQ ID NO: 3072 - protein, 36 aa, Artificial Sequence
  Antimicrobial peptide sequence
GLLRILLRWLFFRGDGGGGGGGGLARILLRLLFRFG

SEQ ID NO: 3073 - protein, 36 aa, Artificial Sequence
  Antimicrobial peptide sequence
GLLRILLRWLFFRGDGGGGGGGGLVRILLRLLFRFG

SEQ ID NO: 3074 - protein, 36 aa, Artificial Sequence
  Antimicrobial peptide sequence
GLLRILLRWLFFRGDGGGGGGGSLVRILLRLLLRFG

SEQ ID NO: 3075 - protein, 36 aa, Artificial Sequence
  Antimicrobial peptide sequence
GLLRILLRWLFFRGDGGGGGGGGLVRILLRLLLRYG

SEQ ID NO: 3076 - protein, 36 aa, Artificial Sequence
  Antimicrobial peptide sequence
GLLRILLRWLFFRGDGGGGGGGGLAWILLRWLFFRG

SEQ ID NO: 3077 - protein, 36 aa, Artificial Sequence
  Antimicrobial peptide sequence
GLLRILLRWLFFRGDGGGGGGGGLVRILLRWLFFRG

SEQ ID NO: 3078 - protein, 36 aa, Artificial Sequence
  Antimicrobial peptide sequence
GLLRILLRWLFFRGDGGGGGGGGLLRILLRWLFFRG

SEQ ID NO: 3079 - protein, 36 aa, Artificial Sequence
  Antimicrobial peptide sequence
GLLRILLRWLFFRGDGGGGGGGGLPWILLRWLFRFG

SEQ ID NO: 3080 - protein, 36 aa, Artificial Sequence
  Antimicrobial peptide sequence
GLLRILLRWLFFRGDGGGGGGGGLLRILLRWLFRFG

SEQ ID NO: 3081 - protein, 36 aa, Artificial Sequence
  Antimicrobial peptide sequence
GLLRILLRWLFFRGDGGGGGGGGLPWILLRWLFRRG

SEQ ID NO: 3082 - protein, 33 aa, Artificial Sequence
  Antimicrobial peptide sequence
GLLRILLRWLFFRGDNNNNGLPWILLRWLFFRG

SEQ ID NO: 3083 - protein, 33 aa, Artificial Sequence
  Antimicrobial peptide sequence
GLLRILLRWLFFRGDNNNNGLARILLRWLFFRG

SEQ ID NO: 3084 - protein, 33 aa, Artificial Sequence
  Antimicrobial peptide sequence
GLLRILLRWLFFRGDNNNNGLARILLRWLFRFG

SEQ ID NO: 3085 - protein, 33 aa, Artificial Sequence
  Antimicrobial peptide sequence
GLLRILLRWLFFRGDNNNNGLVRILLRWLFRFG

SEQ ID NO: 3086 - protein, 33 aa, Artificial Sequence
  Antimicrobial peptide sequence
GLLRILLRWLFFRGDNNNNGLARILLRLLFFRG

SEQ ID NO: 3087 - protein, 33 aa, Artificial Sequence
  Antimicrobial peptide sequence
GLLRILLRWLFFRGDNNNNGLARILLRLLFRFG

SEQ ID NO: 3088 - protein, 33 aa, Artificial Sequence
  Antimicrobial peptide sequence
GLLRILLRWLFFRGDNNNNGLVRILLRLLFRFG

SEQ ID NO: 3089 - protein, 33 aa, Artificial Sequence
  Antimicrobial peptide sequence
GLLRILLRWLFFRGDNNNNSLVRILLRLLLRFG

SEQ ID NO: 3090 - protein, 33 aa, Artificial Sequence
  Antimicrobial peptide sequence
GLLRILLRWLFFRGDNNNNGLVRILLRLLLRYG

SEQ ID NO: 3091 - protein, 33 aa, Artificial Sequence
  Antimicrobial peptide sequence
GLLRILLRWLFFRGDNNNNGLAWILLRWLFFRG

SEQ ID NO: 3092 - protein, 33 aa, Artificial Sequence
  Antimicrobial peptide sequence
GLLRILLRWLFFRGDNNNNGLVRILLRWLFFRG

SEQ ID NO: 3093 - protein, 33 aa, Artificial Sequence
  Antimicrobial peptide sequence
GLLRILLRWLFFRGDNNNNGLLRILLRWLFFRG

SEQ ID NO: 3094 - protein, 33 aa, Artificial Sequence
  Antimicrobial peptide sequence
GLLRILLRWLFFRGDNNNNGLPWILLRWLFRFG

SEQ ID NO: 3095 - protein, 33 aa, Artificial Sequence
  Antimicrobial peptide sequence
GLLRILLRWLFFRGDNNNNGLLRILLRWLFRFG

SEQ ID NO: 3096 - protein, 33 aa, Artificial Sequence
  Antimicrobial peptide sequence
GLLRILLRWLFFRGDNNNNGLPWILLRWLFRRG

SEQ ID NO: 3097 - protein, 34 aa, Artificial Sequence
  Antimicrobial peptide sequence
GLLRILLRWLFFRGDNNNNNGLPWILLRWLFFRG

SEQ ID NO: 3098 - protein, 34 aa, Artificial Sequence
  Antimicrobial peptide sequence
GLLRILLRWLFFRGDNNNNNGLARILLRWLFFRG

SEQ ID NO: 3099 - protein, 34 aa, Artificial Sequence
  Antimicrobial peptide sequence
GLLRILLRWLFFRGDNNNNNGLARILLRWLFRFG

SEQ ID NO: 3100 - protein, 34 aa, Artificial Sequence
  Antimicrobial peptide sequence
GLLRILLRWLFFRGDNNNNNGLVRILLRWLFRFG

SEQ ID NO: 3101 - protein, 34 aa, Artificial Sequence
  Antimicrobial peptide sequence
GLLRILLRWLFFRGDNNNNNGLARILLRLLFFRG

SEQ ID NO: 3102 - protein, 34 aa, Artificial Sequence
  Antimicrobial peptide sequence
GLLRILLRWLFFRGDNNNNNGLARILLRLLFRFG

SEQ ID NO: 3103 - protein, 34 aa, Artificial Sequence
  Antimicrobial peptide sequence
GLLRILLRWLFFRGDNNNNNGLVRILLRLLFRFG

SEQ ID NO: 3104 - protein, 34 aa, Artificial Sequence
  Antimicrobial peptide sequence
GLLRILLRWLFFRGDNNNNNSLVRILLRLLLRFG

SEQ ID NO: 3105 - protein, 34 aa, Artificial Sequence
  Antimicrobial peptide sequence
GLLRILLRWLFFRGDNNNNNGLVRILLRLLLRYG

SEQ ID NO: 3106 - protein, 34 aa, Artificial Sequence
  Antimicrobial peptide sequence
GLLRILLRWLFFRGDNNNNNGLAWILLRWLFFRG

SEQ ID NO: 3107 - protein, 34 aa, Artificial Sequence
  Antimicrobial peptide sequence
GLLRILLRWLFFRGDNNNNNGLVRILLRWLFFRG

SEQ ID NO: 3108 - protein, 34 aa, Artificial Sequence
  Antimicrobial peptide sequence
GLLRILLRWLFFRGDNNNNNGLLRILLRWLFFRG

SEQ ID NO: 3109 - protein, 34 aa, Artificial Sequence
  Antimicrobial peptide sequence
GLLRILLRWLFFRGDNNNNNGLPWILLRWLFRFG

SEQ ID NO: 3110 - protein, 34 aa, Artificial Sequence
  Antimicrobial peptide sequence
GLLRILLRWLFFRGDNNNNNGLLRILLRWLFRFG

SEQ ID NO: 3111 - protein, 34 aa, Artificial Sequence
  Antimicrobial peptide sequence
GLLRILLRWLFFRGDNNNNNGLPWILLRWLFRRG

SEQ ID NO: 3112 - protein, 35 aa, Artificial Sequence
  Antimicrobial peptide sequence
GLLRILLRWLFFRGDNNNNNNGLPWILLRWLFFRG

SEQ ID NO: 3113 - protein, 35 aa, Artificial Sequence
  Antimicrobial peptide sequence
GLLRILLRWLFFRGDNNNNNNGLARILLRWLFFRG

SEQ ID NO: 3114 - protein, 35 aa, Artificial Sequence
  Antimicrobial peptide sequence
GLLRILLRWLFFRGDNNNNNNGLARILLRWLFRFG

SEQ ID NO: 3115 - protein, 35 aa, Artificial Sequence
  Antimicrobial peptide sequence
GLLRILLRWLFFRGDNNNNNNGLVRILLRWLFRFG

SEQ ID NO: 3116 - protein, 35 aa, Artificial Sequence
  Antimicrobial peptide sequence
GLLRILLRWLFFRGDNNNNNNGLARILLRLLFFRG

SEQ ID NO: 3117 - protein, 35 aa, Artificial Sequence
  Antimicrobial peptide sequence
GLLRILLRWLFFRGDNNNNNNGLARILLRLLFRFG

SEQ ID NO: 3118 - protein, 35 aa, Artificial Sequence
  Antimicrobial peptide sequence
GLLRILLRWLFFRGDNNNNNNGLVRILLRLLFRFG

SEQ ID NO: 3119 - protein, 35 aa, Artificial Sequence
  Antimicrobial peptide sequence
GLLRILLRWLFFRGDNNNNNNSLVRILLRLLLRFG

SEQ ID NO: 3120 - protein, 35 aa, Artificial Sequence
  Antimicrobial peptide sequence
GLLRILLRWLFFRGDNNNNNNGLVRILLRLLLRYG

SEQ ID NO: 3121 - protein, 35 aa, Artificial Sequence
  Antimicrobial peptide sequence
GLLRILLRWLFFRGDNNNNNNGLAWILLRWLFFRG

SEQ ID NO: 3122 - protein, 35 aa, Artificial Sequence
  Antimicrobial peptide sequence
GLLRILLRWLFFRGDNNNNNNGLVRILLRWLFFRG

SEQ ID NO: 3123 - protein, 35 aa, Artificial Sequence
  Antimicrobial peptide sequence
GLLRILLRWLFFRGDNNNNNNGLLRILLRWLFFRG

SEQ ID NO: 3124 - protein, 35 aa, Artificial Sequence
  Antimicrobial peptide sequence
GLLRILLRWLFFRGDNNNNNNGLPWILLRWLFRFG

SEQ ID NO: 3125 - protein, 35 aa, Artificial Sequence
  Antimicrobial peptide sequence
GLLRILLRWLFFRGDNNNNNNGLLRILLRWLFRFG

SEQ ID NO: 3126 - protein, 35 aa, Artificial Sequence
  Antimicrobial peptide sequence
GLLRILLRWLFFRGDNNNNNNGLPWILLRWLFRRG

SEQ ID NO: 3127 - protein, 36 aa, Artificial Sequence
  Antimicrobial peptide sequence
GLLRILLRWLFFRGDNNNNNNNGLPWILLRWLFFRG

SEQ ID NO: 3128 - protein, 36 aa, Artificial Sequence
  Antimicrobial peptide sequence
GLLRILLRWLFFRGDNNNNNNNGLARILLRWLFFRG

SEQ ID NO: 3129 - protein, 36 aa, Artificial Sequence
  Antimicrobial peptide sequence
GLLRILLRWLFFRGDNNNNNNNGLARILLRWLFRFG

SEQ ID NO: 3130 - protein, 36 aa, Artificial Sequence
  Antimicrobial peptide sequence
GLLRILLRWLFFRGDNNNNNNNGLVRILLRWLFRFG

SEQ ID NO: 3131 - protein, 36 aa, Artificial Sequence
  Antimicrobial peptide sequence
GLLRILLRWLFFRGDNNNNNNNGLARILLRLLFFRG

SEQ ID NO: 3132 - protein, 36 aa, Artificial Sequence
  Antimicrobial peptide sequence
GLLRILLRWLFFRGDNNNNNNNGLARILLRLLFRFG

SEQ ID NO: 3133 - protein, 36 aa, Artificial Sequence
  Antimicrobial peptide sequence
GLLRILLRWLFFRGDNNNNNNNGLVRILLRLLFRFG

SEQ ID NO: 3134 - protein, 36 aa, Artificial Sequence
  Antimicrobial peptide sequence
GLLRILLRWLFFRGDNNNNNNNSLVRILLRLLLRFG

SEQ ID NO: 3135 - protein, 36 aa, Artificial Sequence
  Antimicrobial peptide sequence
GLLRILLRWLFFRGDNNNNNNNGLVRILLRLLLRYG

SEQ ID NO: 3136 - protein, 36 aa, Artificial Sequence
  Antimicrobial peptide sequence
GLLRILLRWLFFRGDNNNNNNNGLAWILLRWLFFRG

SEQ ID NO: 3137 - protein, 36 aa, Artificial Sequence
  Antimicrobial peptide sequence
GLLRILLRWLFFRGDNNNNNNNGLVRILLRWLFFRG

SEQ ID NO: 3138 - protein, 36 aa, Artificial Sequence
  Antimicrobial peptide sequence
GLLRILLRWLFFRGDNNNNNNNGLLRILLRWLFFRG

SEQ ID NO: 3139 - protein, 36 aa, Artificial Sequence
  Antimicrobial peptide sequence
GLLRILLRWLFFRGDNNNNNNNGLPWILLRWLFRFG

SEQ ID NO: 3140 - protein, 36 aa, Artificial Sequence
  Antimicrobial peptide sequence
GLLRILLRWLFFRGDNNNNNNNGLLRILLRWLFRFG

SEQ ID NO: 3141 - protein, 36 aa, Artificial Sequence
  Antimicrobial peptide sequence
GLLRILLRWLFFRGDNNNNNNNGLPWILLRWLFRRG

SEQ ID NO: 3142 - protein, 35 aa, Artificial Sequence
  Antimicrobial peptide sequence
GLLRILLRWLFFRGDNGNGNGGLPWILLRWLFFRG

SEQ ID NO: 3143 - protein, 35 aa, Artificial Sequence
  Antimicrobial peptide sequence
GLLRILLRWLFFRGDNGNGNGGLARILLRWLFFRG

SEQ ID NO: 3144 - protein, 35 aa, Artificial Sequence
  Antimicrobial peptide sequence
GLLRILLRWLFFRGDNGNGNGGLARILLRWLFRFG

SEQ ID NO: 3145 - protein, 35 aa, Artificial Sequence
  Antimicrobial peptide sequence
GLLRILLRWLFFRGDNGNGNGGLVRILLRWLFRFG

SEQ ID NO: 3146 - protein, 35 aa, Artificial Sequence
  Antimicrobial peptide sequence
GLLRILLRWLFFRGDNGNGNGGLARILLRLLFFRG

SEQ ID NO: 3147 - protein, 35 aa, Artificial Sequence
  Antimicrobial peptide sequence
GLLRILLRWLFFRGDNGNGNGGLARILLRLLFRFG

SEQ ID NO: 3148 - protein, 35 aa, Artificial Sequence
  Antimicrobial peptide sequence
GLLRILLRWLFFRGDNGNGNGGLVRILLRLLFRFG

SEQ ID NO: 3149 - protein, 35 aa, Artificial Sequence
  Antimicrobial peptide sequence
GLLRILLRWLFFRGDNGNGNGSLVRILLRLLLRFG

SEQ ID NO: 3150 - protein, 35 aa, Artificial Sequence
  Antimicrobial peptide sequence
GLLRILLRWLFFRGDNGNGNGGLVRILLRLLLRYG

SEQ ID NO: 3151 - protein, 35 aa, Artificial Sequence
  Antimicrobial peptide sequence
GLLRILLRWLFFRGDNGNGNGGLAWILLRWLFFRG

SEQ ID NO: 3152 - protein, 35 aa, Artificial Sequence
  Antimicrobial peptide sequence
GLLRILLRWLFFRGDNGNGNGGLVRILLRWLFFRG

SEQ ID NO: 3153 - protein, 35 aa, Artificial Sequence
  Antimicrobial peptide sequence
GLLRILLRWLFFRGDNGNGNGGLLRILLRWLFFRG

SEQ ID NO: 3154 - protein, 35 aa, Artificial Sequence
  Antimicrobial peptide sequence
GLLRILLRWLFFRGDNGNGNGGLPWILLRWLFRFG

SEQ ID NO: 3155 - protein, 35 aa, Artificial Sequence
  Antimicrobial peptide sequence
GLLRILLRWLFFRGDNGNGNGGLLRILLRWLFRFG

SEQ ID NO: 3156 - protein, 35 aa, Artificial Sequence
  Antimicrobial peptide sequence
GLLRILLRWLFFRGDNGNGNGGLPWILLRWLFRRG

SEQ ID NO: 3157 - protein, 35 aa, Artificial Sequence
  Antimicrobial peptide sequence
GLLRILLRWLFFRGDGNGNGNGLPWILLRWLFFRG

SEQ ID NO: 3158 - protein, 35 aa, Artificial Sequence
  Antimicrobial peptide sequence
GLLRILLRWLFFRGDGNGNGNGLARILLRWLFFRG

SEQ ID NO: 3159 - protein, 35 aa, Artificial Sequence
  Antimicrobial peptide sequence
GLLRILLRWLFFRGDGNGNGNGLARILLRWLFRFG

SEQ ID NO: 3160 - protein, 35 aa, Artificial Sequence
  Antimicrobial peptide sequence
GLLRILLRWLFFRGDGNGNGNGLVRILLRWLFRFG

SEQ ID NO: 3161 - protein, 35 aa, Artificial Sequence
  Antimicrobial peptide sequence
GLLRILLRWLFFRGDGNGNGNGLARILLRLLFFRG

SEQ ID NO: 3162 - protein, 35 aa, Artificial Sequence
  Antimicrobial peptide sequence
GLLRILLRWLFFRGDGNGNGNGLARILLRLLFRFG

SEQ ID NO: 3163 - protein, 35 aa, Artificial Sequence
  Antimicrobial peptide sequence
GLLRILLRWLFFRGDGNGNGNGLVRILLRLLFRFG

SEQ ID NO: 3164 - protein, 35 aa, Artificial Sequence
  Antimicrobial peptide sequence
GLLRILLRWLFFRGDGNGNGNSLVRILLRLLLRFG

SEQ ID NO: 3165 - protein, 35 aa, Artificial Sequence
  Antimicrobial peptide sequence
GLLRILLRWLFFRGDGNGNGNGLVRILLRLLLRYG

SEQ ID NO: 3166 - protein, 35 aa, Artificial Sequence
  Antimicrobial peptide sequence
GLLRILLRWLFFRGDGNGNGNGLAWILLRWLFFRG

SEQ ID NO: 3167 - protein, 35 aa, Artificial Sequence
  Antimicrobial peptide sequence
GLLRILLRWLFFRGDGNGNGNGLVRILLRWLFFRG

SEQ ID NO: 3168 - protein, 35 aa, Artificial Sequence
  Antimicrobial peptide sequence
GLLRILLRWLFFRGDGNGNGNGLLRILLRWLFFRG

SEQ ID NO: 3169 - protein, 35 aa, Artificial Sequence
  Antimicrobial peptide sequence
GLLRILLRWLFFRGDGNGNGNGLPWILLRWLFRFG

SEQ ID NO: 3170 - protein, 35 aa, Artificial Sequence
  Antimicrobial peptide sequence
GLLRILLRWLFFRGDGNGNGNGLLRILLRWLFRFG

SEQ ID NO: 3171 - protein, 35 aa, Artificial Sequence
  Antimicrobial peptide sequence
GLLRILLRWLFFRGDGNGNGNGLPWILLRWLFRRG

SEQ ID NO: 3172 - protein, 35 aa, Artificial Sequence
  Antimicrobial peptide sequence
GLLRILLRWLFFRGDSGSGSGGLPWILLRWLFFRG

SEQ ID NO: 3173 - protein, 35 aa, Artificial Sequence
  Antimicrobial peptide sequence
GLLRILLRWLFFRGDSGSGSGGLARILLRWLFFRG

SEQ ID NO: 3174 - protein, 35 aa, Artificial Sequence
  Antimicrobial peptide sequence
GLLRILLRWLFFRGDSGSGSGGLARILLRWLFRFG

SEQ ID NO: 3175 - protein, 35 aa, Artificial Sequence
  Antimicrobial peptide sequence
GLLRILLRWLFFRGDSGSGSGGLVRILLRWLFRFG

SEQ ID NO: 3176 - protein, 35 aa, Artificial Sequence
  Antimicrobial peptide sequence
GLLRILLRWLFFRGDSGSGSGGLARILLRLLFFRG

SEQ ID NO: 3177 - protein, 35 aa, Artificial Sequence
  Antimicrobial peptide sequence
GLLRILLRWLFFRGDSGSGSGGLARILLRLLFRFG

SEQ ID NO: 3178 - protein, 35 aa, Artificial Sequence
  Antimicrobial peptide sequence
GLLRILLRWLFFRGDSGSGSGGLVRILLRLLFRFG

SEQ ID NO: 3179 - protein, 35 aa, Artificial Sequence
  Antimicrobial peptide sequence
GLLRILLRWLFFRGDSGSGSGSLVRILLRLLLRFG

SEQ ID NO: 3180 - protein, 35 aa, Artificial Sequence
  Antimicrobial peptide sequence
GLLRILLRWLFFRGDSGSGSGGLVRILLRLLLRYG

SEQ ID NO: 3181 - protein, 35 aa, Artificial Sequence
  Antimicrobial peptide sequence
GLLRILLRWLFFRGDSGSGSGGLAWILLRWLFFRG

SEQ ID NO: 3182 - protein, 35 aa, Artificial Sequence
  Antimicrobial peptide sequence
GLLRILLRWLFFRGDSGSGSGGLVRILLRWLFFRG

SEQ ID NO: 3183 - protein, 35 aa, Artificial Sequence
  Antimicrobial peptide sequence
GLLRILLRWLFFRGDSGSGSGGLLRILLRWLFFRG

SEQ ID NO: 3184 - protein, 35 aa, Artificial Sequence
  Antimicrobial peptide sequence
GLLRILLRWLFFRGDSGSGSGGLPWILLRWLFRFG

SEQ ID NO: 3185 - protein, 35 aa, Artificial Sequence
  Antimicrobial peptide sequence
GLLRILLRWLFFRGDSGSGSGGLLRILLRWLFRFG

SEQ ID NO: 3186 - protein, 35 aa, Artificial Sequence
  Antimicrobial peptide sequence
GLLRILLRWLFFRGDSGSGSGGLPWILLRWLFRRG

SEQ ID NO: 3187 - protein, 35 aa, Artificial Sequence
  Antimicrobial peptide sequence
GLLRILLRWLFFRGDGSGSGSGLPWILLRWLFFRG

SEQ ID NO: 3188 - protein, 35 aa, Artificial Sequence
  Antimicrobial peptide sequence
GLLRILLRWLFFRGDGSGSGSGLARILLRWLFFRG

SEQ ID NO: 3189 - protein, 35 aa, Artificial Sequence
  Antimicrobial peptide sequence
GLLRILLRWLFFRGDGSGSGSGLARILLRWLFRFG

SEQ ID NO: 3190 - protein, 35 aa, Artificial Sequence
  Antimicrobial peptide sequence
GLLRILLRWLFFRGDGSGSGSGLVRILLRWLFRFG

SEQ ID NO: 3191 - protein, 35 aa, Artificial Sequence
  Antimicrobial peptide sequence
GLLRILLRWLFFRGDGSGSGSGLARILLRLLFFRG

SEQ ID NO: 3192 - protein, 35 aa, Artificial Sequence
  Antimicrobial peptide sequence
GLLRILLRWLFFRGDGSGSGSGLARILLRLLFRFG

SEQ ID NO: 3193 - protein, 35 aa, Artificial Sequence
  Antimicrobial peptide sequence
GLLRILLRWLFFRGDGSGSGSGLVRILLRLLFRFG

SEQ ID NO: 3194 - protein, 35 aa, Artificial Sequence
  Antimicrobial peptide sequence
GLLRILLRWLFFRGDGSGSGSSLVRILLRLLLRFG

SEQ ID NO: 3195 - protein, 35 aa, Artificial Sequence
  Antimicrobial peptide sequence
GLLRILLRWLFFRGDGSGSGSGLVRILLRLLLRYG

SEQ ID NO: 3196 - protein, 35 aa, Artificial Sequence
  Antimicrobial peptide sequence
GLLRILLRWLFFRGDGSGSGSGLAWILLRWLFFRG

SEQ ID NO: 3197 - protein, 35 aa, Artificial Sequence
  Antimicrobial peptide sequence
GLLRILLRWLFFRGDGSGSGSGLVRILLRWLFFRG

SEQ ID NO: 3198 - protein, 35 aa, Artificial Sequence
  Antimicrobial peptide sequence
GLLRILLRWLFFRGDGSGSGSGLLRILLRWLFFRG

SEQ ID NO: 3199 - protein, 35 aa, Artificial Sequence
  Antimicrobial peptide sequence
GLLRILLRWLFFRGDGSGSGSGLPWILLRWLFRFG

SEQ ID NO: 3200 - protein, 35 aa, Artificial Sequence
  Antimicrobial peptide sequence
GLLRILLRWLFFRGDGSGSGSGLLRILLRWLFRFG

SEQ ID NO: 3201 - protein, 35 aa, Artificial Sequence
  Antimicrobial peptide sequence
GLLRILLRWLFFRGDGSGSGSGLPWILLRWLFRRG

SEQ ID NO: 3202 - protein, 35 aa, Artificial Sequence
  Antimicrobial peptide sequence
GLLRILLRWLFFRGDSNSNSNGLPWILLRWLFFRG

SEQ ID NO: 3203 - protein, 35 aa, Artificial Sequence
  Antimicrobial peptide sequence
GLLRILLRWLFFRGDSNSNSNGLARILLRWLFFRG

SEQ ID NO: 3204 - protein, 35 aa, Artificial Sequence
  Antimicrobial peptide sequence
GLLRILLRWLFFRGDSNSNSNGLARILLRWLFRFG

SEQ ID NO: 3205 - protein, 35 aa, Artificial Sequence
  Antimicrobial peptide sequence
GLLRILLRWLFFRGDSNSNSNGLVRILLRWLFRFG

SEQ ID NO: 3206 - protein, 35 aa, Artificial Sequence
  Antimicrobial peptide sequence
GLLRILLRWLFFRGDSNSNSNGLARILLRLLFFRG

SEQ ID NO: 3207 - protein, 35 aa, Artificial Sequence
  Antimicrobial peptide sequence
GLLRILLRWLFFRGDSNSNSNGLARILLRLLFRFG

SEQ ID NO: 3208 - protein, 35 aa, Artificial Sequence
  Antimicrobial peptide sequence
GLLRILLRWLFFRGDSNSNSNGLVRILLRLLFRFG

SEQ ID NO: 3209 - protein, 35 aa, Artificial Sequence
  Antimicrobial peptide sequence
GLLRILLRWLFFRGDSNSNSNSLVRILLRLLLRFG

SEQ ID NO: 3210 - protein, 35 aa, Artificial Sequence
  Antimicrobial peptide sequence
GLLRILLRWLFFRGDSNSNSNGLVRILLRLLLRYG

SEQ ID NO: 3211 - protein, 35 aa, Artificial Sequence
  Antimicrobial peptide sequence
GLLRILLRWLFFRGDSNSNSNGLAWILLRWLFFRG

SEQ ID NO: 3212 - protein, 35 aa, Artificial Sequence
  Antimicrobial peptide sequence
GLLRILLRWLFFRGDSNSNSNGLVRILLRWLFFRG

SEQ ID NO: 3213 - protein, 35 aa, Artificial Sequence
  Antimicrobial peptide sequence
GLLRILLRWLFFRGDSNSNSNGLLRILLRWLFFRG

SEQ ID NO: 3214 - protein, 35 aa, Artificial Sequence
  Antimicrobial peptide sequence
GLLRILLRWLFFRGDSNSNSNGLPWILLRWLFRFG

SEQ ID NO: 3215 - protein, 35 aa, Artificial Sequence
  Antimicrobial peptide sequence
GLLRILLRWLFFRGDSNSNSNGLLRILLRWLFRFG

SEQ ID NO: 3216 - protein, 35 aa, Artificial Sequence
  Antimicrobial peptide sequence
GLLRILLRWLFFRGDSNSNSNGLPWILLRWLFRRG

SEQ ID NO: 3217 - protein, 35 aa, Artificial Sequence
  Antimicrobial peptide sequence
GLLRILLRWLFFRGDNSNSNSGLPWILLRWLFFRG

SEQ ID NO: 3218 - protein, 35 aa, Artificial Sequence
  Antimicrobial peptide sequence
GLLRILLRWLFFRGDNSNSNSGLARILLRWLFFRG

SEQ ID NO: 3219 - protein, 35 aa, Artificial Sequence
  Antimicrobial peptide sequence
GLLRILLRWLFFRGDNSNSNSGLARILLRWLFRFG

SEQ ID NO: 3220 - protein, 35 aa, Artificial Sequence
  Antimicrobial peptide sequence
GLLRILLRWLFFRGDNSNSNSGLVRILLRWLFRFG

SEQ ID NO: 3221 - protein, 35 aa, Artificial Sequence
  Antimicrobial peptide sequence
GLLRILLRWLFFRGDNSNSNSGLARILLRLLFFRG

SEQ ID NO: 3222 - protein, 35 aa, Artificial Sequence
  Antimicrobial peptide sequence
GLLRILLRWLFFRGDNSNSNSGLARILLRLLFRFG

SEQ ID NO: 3223 - protein, 35 aa, Artificial Sequence
  Antimicrobial peptide sequence
GLLRILLRWLFFRGDNSNSNSGLVRILLRLLFRFG

SEQ ID NO: 3224 - protein, 35 aa, Artificial Sequence
  Antimicrobial peptide sequence
GLLRILLRWLFFRGDNSNSNSSLVRILLRLLLRFG

SEQ ID NO: 3225 - protein, 35 aa, Artificial Sequence
  Antimicrobial peptide sequence
GLLRILLRWLFFRGDNSNSNSGLVRILLRLLLRYG

SEQ ID NO: 3226 - protein, 35 aa, Artificial Sequence
  Antimicrobial peptide sequence
GLLRILLRWLFFRGDNSNSNSGLAWILLRWLFFRG

SEQ ID NO: 3227 - protein, 35 aa, Artificial Sequence
  Antimicrobial peptide sequence
GLLRILLRWLFFRGDNSNSNSGLVRILLRWLFFRG

SEQ ID NO: 3228 - protein, 35 aa, Artificial Sequence
  Antimicrobial peptide sequence
GLLRILLRWLFFRGDNSNSNSGLLRILLRWLFFRG

SEQ ID NO: 3229 - protein, 35 aa, Artificial Sequence
  Antimicrobial peptide sequence
GLLRILLRWLFFRGDNSNSNSGLPWILLRWLFRFG

SEQ ID NO: 3230 - protein, 35 aa, Artificial Sequence
  Antimicrobial peptide sequence
GLLRILLRWLFFRGDNSNSNSGLLRILLRWLFRFG

SEQ ID NO: 3231 - protein, 35 aa, Artificial Sequence
  Antimicrobial peptide sequence
GLLRILLRWLFFRGDNSNSNSGLPWILLRWLFRRG

SEQ ID NO: 3232 - protein, 35 aa, Artificial Sequence
  Antimicrobial peptide sequence
GLLRILLRWLFFRGDHGHGHGGLPWILLRWLFFRG

SEQ ID NO: 3233 - protein, 35 aa, Artificial Sequence
  Antimicrobial peptide sequence
GLLRILLRWLFFRGDHGHGHGGLARILLRWLFFRG

SEQ ID NO: 3234 - protein, 35 aa, Artificial Sequence
  Antimicrobial peptide sequence
GLLRILLRWLFFRGDHGHGHGGLARILLRWLFRFG

SEQ ID NO: 3235 - protein, 35 aa, Artificial Sequence
  Antimicrobial peptide sequence
GLLRILLRWLFFRGDHGHGHGGLVRILLRWLFRFG

SEQ ID NO: 3236 - protein, 35 aa, Artificial Sequence
  Antimicrobial peptide sequence
GLLRILLRWLFFRGDHGHGHGGLARILLRLLFFRG

SEQ ID NO: 3237 - protein, 35 aa, Artificial Sequence
  Antimicrobial peptide sequence
GLLRILLRWLFFRGDHGHGHGGLARILLRLLFRFG

SEQ ID NO: 3238 - protein, 35 aa, Artificial Sequence
  Antimicrobial peptide sequence
GLLRILLRWLFFRGDHGHGHGGLVRILLRLLFRFG

SEQ ID NO: 3239 - protein, 35 aa, Artificial Sequence
  Antimicrobial peptide sequence
GLLRILLRWLFFRGDHGHGHGSLVRILLRLLLRFG

SEQ ID NO: 3240 - protein, 35 aa, Artificial Sequence
  Antimicrobial peptide sequence
GLLRILLRWLFFRGDHGHGHGGLVRILLRLLLRYG

SEQ ID NO: 3241 - protein, 35 aa, Artificial Sequence
  Antimicrobial peptide sequence
GLLRILLRWLFFRGDHGHGHGGLAWILLRWLFFRG

SEQ ID NO: 3242 - protein, 35 aa, Artificial Sequence
  Antimicrobial peptide sequence
GLLRILLRWLFFRGDHGHGHGGLVRILLRWLFFRG

SEQ ID NO: 3243 - protein, 35 aa, Artificial Sequence
  Antimicrobial peptide sequence
GLLRILLRWLFFRGDHGHGHGGLLRILLRWLFFRG

SEQ ID NO: 3244 - protein, 35 aa, Artificial Sequence
  Antimicrobial peptide sequence
GLLRILLRWLFFRGDHGHGHGGLPWILLRWLFRFG

SEQ ID NO: 3245 - protein, 35 aa, Artificial Sequence
  Antimicrobial peptide sequence
GLLRILLRWLFFRGDHGHGHGGLLRILLRWLFRFG

SEQ ID NO: 3246 - protein, 35 aa, Artificial Sequence
  Antimicrobial peptide sequence
GLLRILLRWLFFRGDHGHGHGGLPWILLRWLFRRG

SEQ ID NO: 3247 - protein, 35 aa, Artificial Sequence
  Antimicrobial peptide sequence
GLLRILLRWLFFRGDGHGHGHGLPWILLRWLFFRG

SEQ ID NO: 3248 - protein, 35 aa, Artificial Sequence
  Antimicrobial peptide sequence
GLLRILLRWLFFRGDGHGHGHGLARILLRWLFFRG

SEQ ID NO: 3249 - protein, 35 aa, Artificial Sequence
  Antimicrobial peptide sequence
GLLRILLRWLFFRGDGHGHGHGLARILLRWLFRFG

SEQ ID NO: 3250 - protein, 35 aa, Artificial Sequence
  Antimicrobial peptide sequence
GLLRILLRWLFFRGDGHGHGHGLVRILLRWLFRFG

SEQ ID NO: 3251 - protein, 35 aa, Artificial Sequence
  Antimicrobial peptide sequence
GLLRILLRWLFFRGDGHGHGHGLARILLRLLFFRG

SEQ ID NO: 3252 - protein, 35 aa, Artificial Sequence
  Antimicrobial peptide sequence
GLLRILLRWLFFRGDGHGHGHGLARILLRLLFRFG

SEQ ID NO: 3253 - protein, 35 aa, Artificial Sequence
  Antimicrobial peptide sequence
GLLRILLRWLFFRGDGHGHGHGLVRILLRLLFRFG

SEQ ID NO: 3254 - protein, 35 aa, Artificial Sequence
  Antimicrobial peptide sequence
GLLRILLRWLFFRGDGHGHGHSLVRILLRLLLRFG

SEQ ID NO: 3255 - protein, 35 aa, Artificial Sequence
  Antimicrobial peptide sequence
GLLRILLRWLFFRGDGHGHGHGLVRILLRLLLRYG

SEQ ID NO: 3256 - protein, 35 aa, Artificial Sequence
  Antimicrobial peptide sequence
GLLRILLRWLFFRGDGHGHGHGLAWILLRWLFFRG

SEQ ID NO: 3257 - protein, 35 aa, Artificial Sequence
  Antimicrobial peptide sequence
GLLRILLRWLFFRGDGHGHGHGLVRILLRWLFFRG

SEQ ID NO: 3258 - protein, 35 aa, Artificial Sequence
  Antimicrobial peptide sequence
GLLRILLRWLFFRGDGHGHGHGLLRILLRWLFFRG

SEQ ID NO: 3259 - protein, 35 aa, Artificial Sequence
  Antimicrobial peptide sequence
GLLRILLRWLFFRGDGHGHGHGLPWILLRWLFRFG

SEQ ID NO: 3260 - protein, 35 aa, Artificial Sequence
  Antimicrobial peptide sequence
GLLRILLRWLFFRGDGHGHGHGLLRILLRWLFRFG

SEQ ID NO: 3261 - protein, 35 aa, Artificial Sequence
  Antimicrobial peptide sequence
GLLRILLRWLFFRGDGHGHGHGLPWILLRWLFRRG

SEQ ID NO: 3262 - protein, 35 aa, Artificial Sequence
  Antimicrobial peptide sequence
GLLRILLRWLFFRGDHNHNHNGLPWILLRWLFFRG

SEQ ID NO: 3263 - protein, 35 aa, Artificial Sequence
  Antimicrobial peptide sequence
GLLRILLRWLFFRGDHNHNHNGLARILLRWLFFRG

SEQ ID NO: 3264 - protein, 35 aa, Artificial Sequence
  Antimicrobial peptide sequence
GLLRILLRWLFFRGDHNHNHNGLARILLRWLFRFG

SEQ ID NO: 3265 - protein, 35 aa, Artificial Sequence
  Antimicrobial peptide sequence
GLLRILLRWLFFRGDHNHNHNGLVRILLRWLFRFG

SEQ ID NO: 3266 - protein, 35 aa, Artificial Sequence
  Antimicrobial peptide sequence
GLLRILLRWLFFRGDHNHNHNGLARILLRLLFFRG

SEQ ID NO: 3267 - protein, 35 aa, Artificial Sequence
  Antimicrobial peptide sequence
GLLRILLRWLFFRGDHNHNHNGLARILLRLLFRFG

SEQ ID NO: 3268 - protein, 35 aa, Artificial Sequence
  Antimicrobial peptide sequence
GLLRILLRWLFFRGDHNHNHNGLVRILLRLLFRFG

SEQ ID NO: 3269 - protein, 35 aa, Artificial Sequence
  Antimicrobial peptide sequence
GLLRILLRWLFFRGDHNHNHNSLVRILLRLLLRFG

SEQ ID NO: 3270 - protein, 35 aa, Artificial Sequence
  Antimicrobial peptide sequence
GLLRILLRWLFFRGDHNHNHNGLVRILLRLLLRYG

SEQ ID NO: 3271 - protein, 35 aa, Artificial Sequence
  Antimicrobial peptide sequence
GLLRILLRWLFFRGDHNHNHNGLAWILLRWLFFRG

SEQ ID NO: 3272 - protein, 35 aa, Artificial Sequence
  Antimicrobial peptide sequence
GLLRILLRWLFFRGDHNHNHNGLVRILLRWLFFRG

SEQ ID NO: 3273 - protein, 35 aa, Artificial Sequence
  Antimicrobial peptide sequence
GLLRILLRWLFFRGDHNHNHNGLLRILLRWLFFRG

SEQ ID NO: 3274 - protein, 35 aa, Artificial Sequence
  Antimicrobial peptide sequence
GLLRILLRWLFFRGDHNHNHNGLPWILLRWLFRFG

SEQ ID NO: 3275 - protein, 35 aa, Artificial Sequence
  Antimicrobial peptide sequence
GLLRILLRWLFFRGDHNHNHNGLLRILLRWLFRFG

SEQ ID NO: 3276 - protein, 35 aa, Artificial Sequence
  Antimicrobial peptide sequence
GLLRILLRWLFFRGDHNHNHNGLPWILLRWLFRRG

SEQ ID NO: 3277 - protein, 35 aa, Artificial Sequence
  Antimicrobial peptide sequence
GLLRILLRWLFFRGDNHNHNHGLPWILLRWLFFRG

SEQ ID NO: 3278 - protein, 35 aa, Artificial Sequence
  Antimicrobial peptide sequence
GLLRILLRWLFFRGDNHNHNHGLARILLRWLFFRG

SEQ ID NO: 3279 - protein, 35 aa, Artificial Sequence
  Antimicrobial peptide sequence
GLLRILLRWLFFRGDNHNHNHGLARILLRWLFRFG

SEQ ID NO: 3280 - protein, 35 aa, Artificial Sequence
  Antimicrobial peptide sequence
GLLRILLRWLFFRGDNHNHNHGLVRILLRWLFRFG

SEQ ID NO: 3281 - protein, 35 aa, Artificial Sequence
  Antimicrobial peptide sequence
GLLRILLRWLFFRGDNHNHNHGLARILLRLLFFRG

SEQ ID NO: 3282 - protein, 35 aa, Artificial Sequence
  Antimicrobial peptide sequence
GLLRILLRWLFFRGDNHNHNHGLARILLRLLFRFG

SEQ ID NO: 3283 - protein, 35 aa, Artificial Sequence
  Antimicrobial peptide sequence
GLLRILLRWLFFRGDNHNHNHGLVRILLRLLFRFG

SEQ ID NO: 3284 - protein, 35 aa, Artificial Sequence
  Antimicrobial peptide sequence
GLLRILLRWLFFRGDNHNHNHSLVRILLRLLLRFG

SEQ ID NO: 3285 - protein, 35 aa, Artificial Sequence
  Antimicrobial peptide sequence
GLLRILLRWLFFRGDNHNHNHGLVRILLRLLLRYG

SEQ ID NO: 3286 - protein, 35 aa, Artificial Sequence
  Antimicrobial peptide sequence
GLLRILLRWLFFRGDNHNHNHGLAWILLRWLFFRG

SEQ ID NO: 3287 - protein, 35 aa, Artificial Sequence
  Antimicrobial peptide sequence
GLLRILLRWLFFRGDNHNHNHGLVRILLRWLFFRG

SEQ ID NO: 3288 - protein, 35 aa, Artificial Sequence
  Antimicrobial peptide sequence
GLLRILLRWLFFRGDNHNHNHGLLRILLRWLFFRG

SEQ ID NO: 3289 - protein, 35 aa, Artificial Sequence
  Antimicrobial peptide sequence
GLLRILLRWLFFRGDNHNHNHGLPWILLRWLFRFG

SEQ ID NO: 3290 - protein, 35 aa, Artificial Sequence
  Antimicrobial peptide sequence
GLLRILLRWLFFRGDNHNHNHGLLRILLRWLFRFG

SEQ ID NO: 3291 - protein, 35 aa, Artificial Sequence
  Antimicrobial peptide sequence
GLLRILLRWLFFRGDNHNHNHGLPWILLRWLFRRG

SEQ ID NO: 3292 - protein, 33 aa, Artificial Sequence
  Antimicrobial peptide sequence
GLPWILLRWLFRFGDGGGGGLPWILLRWLFFRG

SEQ ID NO: 3293 - protein, 33 aa, Artificial Sequence
  Antimicrobial peptide sequence
GLPWILLRWLFRFGDGGGGGLARILLRWLFFRG

SEQ ID NO: 3294 - protein, 33 aa, Artificial Sequence
  Antimicrobial peptide sequence
GLPWILLRWLFRFGDGGGGGLARILLRWLFRFG

SEQ ID NO: 3295 - protein, 33 aa, Artificial Sequence
  Antimicrobial peptide sequence
GLPWILLRWLFRFGDGGGGGLVRILLRWLFRFG

SEQ ID NO: 3296 - protein, 33 aa, Artificial Sequence
  Antimicrobial peptide sequence
GLPWILLRWLFRFGDGGGGGLARILLRLLFFRG

SEQ ID NO: 3297 - protein, 33 aa, Artificial Sequence
  Antimicrobial peptide sequence
GLPWILLRWLFRFGDGGGGGLARILLRLLFRFG

SEQ ID NO: 3298 - protein, 33 aa, Artificial Sequence
  Antimicrobial peptide sequence
GLPWILLRWLFRFGDGGGGGLVRILLRLLFRFG

SEQ ID NO: 3299 - protein, 33 aa, Artificial Sequence
  Antimicrobial peptide sequence
GLPWILLRWLFRFGDGGGGSLVRILLRLLLRFG

SEQ ID NO: 3300 - protein, 33 aa, Artificial Sequence
  Antimicrobial peptide sequence
GLPWILLRWLFRFGDGGGGGLVRILLRLLLRYG

SEQ ID NO: 3301 - protein, 33 aa, Artificial Sequence
  Antimicrobial peptide sequence
GLPWILLRWLFRFGDGGGGGLAWILLRWLFFRG

SEQ ID NO: 3302 - protein, 33 aa, Artificial Sequence
  Antimicrobial peptide sequence
GLPWILLRWLFRFGDGGGGGLVRILLRWLFFRG

SEQ ID NO: 3303 - protein, 33 aa, Artificial Sequence
  Antimicrobial peptide sequence
GLPWILLRWLFRFGDGGGGGLLRILLRWLFFRG

SEQ ID NO: 3304 - protein, 33 aa, Artificial Sequence
  Antimicrobial peptide sequence
GLPWILLRWLFRFGDGGGGGLPWILLRWLFRFG

SEQ ID NO: 3305 - protein, 33 aa, Artificial Sequence
  Antimicrobial peptide sequence
GLPWILLRWLFRFGDGGGGGLLRILLRWLFRFG

SEQ ID NO: 3306 - protein, 33 aa, Artificial Sequence
  Antimicrobial peptide sequence
GLPWILLRWLFRFGDGGGGGLPWILLRWLFRRG

SEQ ID NO: 3307 - protein, 34 aa, Artificial Sequence
  Antimicrobial peptide sequence
GLPWILLRWLFRFGDGGGGGGLPWILLRWLFFRG

SEQ ID NO: 3308 - protein, 34 aa, Artificial Sequence
  Antimicrobial peptide sequence
GLPWILLRWLFRFGDGGGGGGLARILLRWLFFRG

SEQ ID NO: 3309 - protein, 34 aa, Artificial Sequence
  Antimicrobial peptide sequence
GLPWILLRWLFRFGDGGGGGGLARILLRWLFRFG

SEQ ID NO: 3310 - protein, 34 aa, Artificial Sequence
  Antimicrobial peptide sequence
GLPWILLRWLFRFGDGGGGGGLVRILLRWLFRFG

SEQ ID NO: 3311 - protein, 34 aa, Artificial Sequence
  Antimicrobial peptide sequence
GLPWILLRWLFRFGDGGGGGGLARILLRLLFFRG

SEQ ID NO: 3312 - protein, 34 aa, Artificial Sequence
  Antimicrobial peptide sequence
GLPWILLRWLFRFGDGGGGGGLARILLRLLFRFG

SEQ ID NO: 3313 - protein, 34 aa, Artificial Sequence
  Antimicrobial peptide sequence
GLPWILLRWLFRFGDGGGGGGLVRILLRLLFRFG

SEQ ID NO: 3314 - protein, 34 aa, Artificial Sequence
  Antimicrobial peptide sequence
GLPWILLRWLFRFGDGGGGGSLVRILLRLLLRFG

SEQ ID NO: 3315 - protein, 34 aa, Artificial Sequence
  Antimicrobial peptide sequence
GLPWILLRWLFRFGDGGGGGGLVRILLRLLLRYG

SEQ ID NO: 3316 - protein, 34 aa, Artificial Sequence
  Antimicrobial peptide sequence
GLPWILLRWLFRFGDGGGGGGLAWILLRWLFFRG

SEQ ID NO: 3317 - protein, 34 aa, Artificial Sequence
  Antimicrobial peptide sequence
GLPWILLRWLFRFGDGGGGGGLVRILLRWLFFRG

SEQ ID NO: 3318 - protein, 34 aa, Artificial Sequence
  Antimicrobial peptide sequence
GLPWILLRWLFRFGDGGGGGGLLRILLRWLFFRG

SEQ ID NO: 3319 - protein, 34 aa, Artificial Sequence
  Antimicrobial peptide sequence
GLPWILLRWLFRFGDGGGGGGLPWILLRWLFRFG

SEQ ID NO: 3320 - protein, 34 aa, Artificial Sequence
  Antimicrobial peptide sequence
GLPWILLRWLFRFGDGGGGGGLLRILLRWLFRFG

SEQ ID NO: 3321 - protein, 34 aa, Artificial Sequence
  Antimicrobial peptide sequence
GLPWILLRWLFRFGDGGGGGGLPWILLRWLFRRG

SEQ ID NO: 3322 - protein, 35 aa, Artificial Sequence
  Antimicrobial peptide sequence
GLPWILLRWLFRFGDGGGGGGGLPWILLRWLFFRG

SEQ ID NO: 3323 - protein, 35 aa, Artificial Sequence
  Antimicrobial peptide sequence
GLPWILLRWLFRFGDGGGGGGGLARILLRWLFFRG

SEQ ID NO: 3324 - protein, 35 aa, Artificial Sequence
  Antimicrobial peptide sequence
GLPWILLRWLFRFGDGGGGGGGLARILLRWLFRFG

SEQ ID NO: 3325 - protein, 35 aa, Artificial Sequence
  Antimicrobial peptide sequence
GLPWILLRWLFRFGDGGGGGGGLVRILLRWLFRFG

SEQ ID NO: 3326 - protein, 35 aa, Artificial Sequence
  Antimicrobial peptide sequence
GLPWILLRWLFRFGDGGGGGGGLARILLRLLFFRG

SEQ ID NO: 3327 - protein, 35 aa, Artificial Sequence
  Antimicrobial peptide sequence
GLPWILLRWLFRFGDGGGGGGGLARILLRLLFRFG

SEQ ID NO: 3328 - protein, 35 aa, Artificial Sequence
  Antimicrobial peptide sequence
GLPWILLRWLFRFGDGGGGGGGLVRILLRLLFRFG

SEQ ID NO: 3329 - protein, 35 aa, Artificial Sequence
  Antimicrobial peptide sequence
GLPWILLRWLFRFGDGGGGGGSLVRILLRLLLRFG

SEQ ID NO: 3330 - protein, 35 aa, Artificial Sequence
  Antimicrobial peptide sequence
GLPWILLRWLFRFGDGGGGGGGLVRILLRLLLRYG

SEQ ID NO: 3331 - protein, 35 aa, Artificial Sequence
  Antimicrobial peptide sequence
GLPWILLRWLFRFGDGGGGGGGLAWILLRWLFFRG

SEQ ID NO: 3332 - protein, 35 aa, Artificial Sequence
  Antimicrobial peptide sequence
GLPWILLRWLFRFGDGGGGGGGLVRILLRWLFFRG

SEQ ID NO: 3333 - protein, 35 aa, Artificial Sequence
  Antimicrobial peptide sequence
GLPWILLRWLFRFGDGGGGGGGLLRILLRWLFFRG

SEQ ID NO: 3334 - protein, 35 aa, Artificial Sequence
  Antimicrobial peptide sequence
GLPWILLRWLFRFGDGGGGGGGLPWILLRWLFRFG

SEQ ID NO: 3335 - protein, 35 aa, Artificial Sequence
  Antimicrobial peptide sequence
GLPWILLRWLFRFGDGGGGGGGLLRILLRWLFRFG

SEQ ID NO: 3336 - protein, 35 aa, Artificial Sequence
  Antimicrobial peptide sequence
GLPWILLRWLFRFGDGGGGGGGLPWILLRWLFRRG

SEQ ID NO: 3337 - protein, 36 aa, Artificial Sequence
  Antimicrobial peptide sequence
GLPWILLRWLFRFGDGGGGGGGGLPWILLRWLFFRG

SEQ ID NO: 3338 - protein, 36 aa, Artificial Sequence
  Antimicrobial peptide sequence
GLPWILLRWLFRFGDGGGGGGGGLARILLRWLFFRG

SEQ ID NO: 3339 - protein, 36 aa, Artificial Sequence
  Antimicrobial peptide sequence
GLPWILLRWLFRFGDGGGGGGGGLARILLRWLFRFG

SEQ ID NO: 3340 - protein, 36 aa, Artificial Sequence
  Antimicrobial peptide sequence
GLPWILLRWLFRFGDGGGGGGGGLVRILLRWLFRFG

SEQ ID NO: 3341 - protein, 36 aa, Artificial Sequence
  Antimicrobial peptide sequence
GLPWILLRWLFRFGDGGGGGGGGLARILLRLLFFRG

SEQ ID NO: 3342 - protein, 36 aa, Artificial Sequence
  Antimicrobial peptide sequence
GLPWILLRWLFRFGDGGGGGGGGLARILLRLLFRFG

SEQ ID NO: 3343 - protein, 36 aa, Artificial Sequence
  Antimicrobial peptide sequence
GLPWILLRWLFRFGDGGGGGGGGLVRILLRLLFRFG

SEQ ID NO: 3344 - protein, 36 aa, Artificial Sequence
  Antimicrobial peptide sequence
GLPWILLRWLFRFGDGGGGGGGSLVRILLRLLLRFG

SEQ ID NO: 3345 - protein, 36 aa, Artificial Sequence
  Antimicrobial peptide sequence
GLPWILLRWLFRFGDGGGGGGGGLVRILLRLLLRYG

SEQ ID NO: 3346 - protein, 36 aa, Artificial Sequence
  Antimicrobial peptide sequence
GLPWILLRWLFRFGDGGGGGGGGLAWILLRWLFFRG

SEQ ID NO: 3347 - protein, 36 aa, Artificial Sequence
  Antimicrobial peptide sequence
GLPWILLRWLFRFGDGGGGGGGGLVRILLRWLFFRG

SEQ ID NO: 3348 - protein, 36 aa, Artificial Sequence
  Antimicrobial peptide sequence
GLPWILLRWLFRFGDGGGGGGGGLLRILLRWLFFRG

SEQ ID NO: 3349 - protein, 36 aa, Artificial Sequence
  Antimicrobial peptide sequence
GLPWILLRWLFRFGDGGGGGGGGLPWILLRWLFRFG

SEQ ID NO: 3350 - protein, 36 aa, Artificial Sequence
  Antimicrobial peptide sequence
GLPWILLRWLFRFGDGGGGGGGGLLRILLRWLFRFG

SEQ ID NO: 3351 - protein, 36 aa, Artificial Sequence
  Antimicrobial peptide sequence
GLPWILLRWLFRFGDGGGGGGGGLPWILLRWLFRRG

SEQ ID NO: 3352 - protein, 33 aa, Artificial Sequence
  Antimicrobial peptide sequence
GLPWILLRWLFRFGDNNNNGLPWILLRWLFFRG

SEQ ID NO: 3353 - protein, 33 aa, Artificial Sequence
  Antimicrobial peptide sequence
GLPWILLRWLFRFGDNNNNGLARILLRWLFFRG

SEQ ID NO: 3354 - protein, 33 aa, Artificial Sequence
  Antimicrobial peptide sequence
GLPWILLRWLFRFGDNNNNGLARILLRWLFRFG

SEQ ID NO: 3355 - protein, 33 aa, Artificial Sequence
  Antimicrobial peptide sequence
GLPWILLRWLFRFGDNNNNGLVRILLRWLFRFG

SEQ ID NO: 3356 - protein, 33 aa, Artificial Sequence
  Antimicrobial peptide sequence
GLPWILLRWLFRFGDNNNNGLARILLRLLFFRG

SEQ ID NO: 3357 - protein, 33 aa, Artificial Sequence
  Antimicrobial peptide sequence
GLPWILLRWLFRFGDNNNNGLARILLRLLFRFG

SEQ ID NO: 3358 - protein, 33 aa, Artificial Sequence
  Antimicrobial peptide sequence
GLPWILLRWLFRFGDNNNNGLVRILLRLLFRFG

SEQ ID NO: 3359 - protein, 33 aa, Artificial Sequence
  Antimicrobial peptide sequence
GLPWILLRWLFRFGDNNNNSLVRILLRLLLRFG

SEQ ID NO: 3360 - protein, 33 aa, Artificial Sequence
  Antimicrobial peptide sequence
GLPWILLRWLFRFGDNNNNGLVRILLRLLLRYG

SEQ ID NO: 3361 - protein, 33 aa, Artificial Sequence
  Antimicrobial peptide sequence
GLPWILLRWLFRFGDNNNNGLAWILLRWLFFRG

SEQ ID NO: 3362 - protein, 33 aa, Artificial Sequence
  Antimicrobial peptide sequence
GLPWILLRWLFRFGDNNNNGLVRILLRWLFFRG

SEQ ID NO: 3363 - protein, 33 aa, Artificial Sequence
  Antimicrobial peptide sequence
GLPWILLRWLFRFGDNNNNGLLRILLRWLFFRG

SEQ ID NO: 3364 - protein, 33 aa, Artificial Sequence
  Antimicrobial peptide sequence
GLPWILLRWLFRFGDNNNNGLPWILLRWLFRFG

SEQ ID NO: 3365 - protein, 33 aa, Artificial Sequence
  Antimicrobial peptide sequence
GLPWILLRWLFRFGDNNNNGLLRILLRWLFRFG

SEQ ID NO: 3366 - protein, 33 aa, Artificial Sequence
  Antimicrobial peptide sequence
GLPWILLRWLFRFGDNNNNGLPWILLRWLFRRG

SEQ ID NO: 3367 - protein, 34 aa, Artificial Sequence
  Antimicrobial peptide sequence
GLPWILLRWLFRFGDNNNNNGLPWILLRWLFFRG

SEQ ID NO: 3368 - protein, 34 aa, Artificial Sequence
  Antimicrobial peptide sequence
GLPWILLRWLFRFGDNNNNNGLARILLRWLFFRG

SEQ ID NO: 3369 - protein, 34 aa, Artificial Sequence
  Antimicrobial peptide sequence
GLPWILLRWLFRFGDNNNNNGLARILLRWLFRFG

SEQ ID NO: 3370 - protein, 34 aa, Artificial Sequence
  Antimicrobial peptide sequence
GLPWILLRWLFRFGDNNNNNGLVRILLRWLFRFG

SEQ ID NO: 3371 - protein, 34 aa, Artificial Sequence
  Antimicrobial peptide sequence
GLPWILLRWLFRFGDNNNNNGLARILLRLLFFRG

SEQ ID NO: 3372 - protein, 34 aa, Artificial Sequence
  Antimicrobial peptide sequence
GLPWILLRWLFRFGDNNNNNGLARILLRLLFRFG

SEQ ID NO: 3373 - protein, 34 aa, Artificial Sequence
  Antimicrobial peptide sequence
GLPWILLRWLFRFGDNNNNNGLVRILLRLLFRFG

SEQ ID NO: 3374 - protein, 34 aa, Artificial Sequence
  Antimicrobial peptide sequence
GLPWILLRWLFRFGDNNNNNSLVRILLRLLLRFG

SEQ ID NO: 3375 - protein, 34 aa, Artificial Sequence
  Antimicrobial peptide sequence
GLPWILLRWLFRFGDNNNNNGLVRILLRLLLRYG

SEQ ID NO: 3376 - protein, 34 aa, Artificial Sequence
  Antimicrobial peptide sequence
GLPWILLRWLFRFGDNNNNNGLAWILLRWLFFRG

SEQ ID NO: 3377 - protein, 34 aa, Artificial Sequence
  Antimicrobial peptide sequence
GLPWILLRWLFRFGDNNNNNGLVRILLRWLFFRG

SEQ ID NO: 3378 - protein, 34 aa, Artificial Sequence
  Antimicrobial peptide sequence
GLPWILLRWLFRFGDNNNNNGLLRILLRWLFFRG

SEQ ID NO: 3379 - protein, 34 aa, Artificial Sequence
  Antimicrobial peptide sequence
GLPWILLRWLFRFGDNNNNNGLPWILLRWLFRFG

SEQ ID NO: 3380 - protein, 34 aa, Artificial Sequence
  Antimicrobial peptide sequence
GLPWILLRWLFRFGDNNNNNGLLRILLRWLFRFG

SEQ ID NO: 3381 - protein, 34 aa, Artificial Sequence
  Antimicrobial peptide sequence
GLPWILLRWLFRFGDNNNNNGLPWILLRWLFRRG

SEQ ID NO: 3382 - protein, 35 aa, Artificial Sequence
  Antimicrobial peptide sequence
GLPWILLRWLFRFGDNNNNNNGLPWILLRWLFFRG

SEQ ID NO: 3383 - protein, 35 aa, Artificial Sequence
  Antimicrobial peptide sequence
GLPWILLRWLFRFGDNNNNNNGLARILLRWLFFRG

SEQ ID NO: 3384 - protein, 35 aa, Artificial Sequence
  Antimicrobial peptide sequence
GLPWILLRWLFRFGDNNNNNNGLARILLRWLFRFG

SEQ ID NO: 3385 - protein, 35 aa, Artificial Sequence
  Antimicrobial peptide sequence
GLPWILLRWLFRFGDNNNNNNGLVRILLRWLFRFG

SEQ ID NO: 3386 - protein, 35 aa, Artificial Sequence
  Antimicrobial peptide sequence
GLPWILLRWLFRFGDNNNNNNGLARILLRLLFFRG

SEQ ID NO: 3387 - protein, 35 aa, Artificial Sequence
  Antimicrobial peptide sequence
GLPWILLRWLFRFGDNNNNNNGLARILLRLLFRFG

SEQ ID NO: 3388 - protein, 35 aa, Artificial Sequence
  Antimicrobial peptide sequence
GLPWILLRWLFRFGDNNNNNNGLVRILLRLLFRFG

SEQ ID NO: 3389 - protein, 35 aa, Artificial Sequence
  Antimicrobial peptide sequence
GLPWILLRWLFRFGDNNNNNNSLVRILLRLLLRFG

SEQ ID NO: 3390 - protein, 35 aa, Artificial Sequence
  Antimicrobial peptide sequence
GLPWILLRWLFRFGDNNNNNNGLVRILLRLLLRYG

SEQ ID NO: 3391 - protein, 35 aa, Artificial Sequence
  Antimicrobial peptide sequence
GLPWILLRWLFRFGDNNNNNNGLAWILLRWLFFRG

SEQ ID NO: 3392 - protein, 35 aa, Artificial Sequence
  Antimicrobial peptide sequence
GLPWILLRWLFRFGDNNNNNNGLVRILLRWLFFRG

SEQ ID NO: 3393 - protein, 35 aa, Artificial Sequence
  Antimicrobial peptide sequence
GLPWILLRWLFRFGDNNNNNNGLLRILLRWLFFRG

SEQ ID NO: 3394 - protein, 35 aa, Artificial Sequence
  Antimicrobial peptide sequence
GLPWILLRWLFRFGDNNNNNNGLPWILLRWLFRFG

SEQ ID NO: 3395 - protein, 35 aa, Artificial Sequence
  Antimicrobial peptide sequence
GLPWILLRWLFRFGDNNNNNNGLLRILLRWLFRFG

SEQ ID NO: 3396 - protein, 35 aa, Artificial Sequence
  Antimicrobial peptide sequence
GLPWILLRWLFRFGDNNNNNNGLPWILLRWLFRRG

SEQ ID NO: 3397 - protein, 36 aa, Artificial Sequence
  Antimicrobial peptide sequence
GLPWILLRWLFRFGDNNNNNNNGLPWILLRWLFFRG

SEQ ID NO: 3398 - protein, 36 aa, Artificial Sequence
  Antimicrobial peptide sequence
GLPWILLRWLFRFGDNNNNNNNGLARILLRWLFFRG

SEQ ID NO: 3399 - protein, 36 aa, Artificial Sequence
  Antimicrobial peptide sequence
GLPWILLRWLFRFGDNNNNNNNGLARILLRWLFRFG

SEQ ID NO: 3400 - protein, 36 aa, Artificial Sequence
  Antimicrobial peptide sequence
GLPWILLRWLFRFGDNNNNNNNGLVRILLRWLFRFG

SEQ ID NO: 3401 - protein, 36 aa, Artificial Sequence
  Antimicrobial peptide sequence
GLPWILLRWLFRFGDNNNNNNNGLARILLRLLFFRG

SEQ ID NO: 3402 - protein, 36 aa, Artificial Sequence
  Antimicrobial peptide sequence
GLPWILLRWLFRFGDNNNNNNNGLARILLRLLFRFG

SEQ ID NO: 3403 - protein, 36 aa, Artificial Sequence
  Antimicrobial peptide sequence
GLPWILLRWLFRFGDNNNNNNNGLVRILLRLLFRFG

SEQ ID NO: 3404 - protein, 36 aa, Artificial Sequence
  Antimicrobial peptide sequence
GLPWILLRWLFRFGDNNNNNNNSLVRILLRLLLRFG

SEQ ID NO: 3405 - protein, 36 aa, Artificial Sequence
  Antimicrobial peptide sequence
GLPWILLRWLFRFGDNNNNNNNGLVRILLRLLLRYG

SEQ ID NO: 3406 - protein, 36 aa, Artificial Sequence
  Antimicrobial peptide sequence
GLPWILLRWLFRFGDNNNNNNNGLAWILLRWLFFRG

SEQ ID NO: 3407 - protein, 36 aa, Artificial Sequence
  Antimicrobial peptide sequence
GLPWILLRWLFRFGDNNNNNNNGLVRILLRWLFFRG

SEQ ID NO: 3408 - protein, 36 aa, Artificial Sequence
  Antimicrobial peptide sequence
GLPWILLRWLFRFGDNNNNNNNGLLRILLRWLFFRG

SEQ ID NO: 3409 - protein, 36 aa, Artificial Sequence
  Antimicrobial peptide sequence
GLPWILLRWLFRFGDNNNNNNNGLPWILLRWLFRFG

SEQ ID NO: 3410 - protein, 36 aa, Artificial Sequence
  Antimicrobial peptide sequence
GLPWILLRWLFRFGDNNNNNNNGLLRILLRWLFRFG

SEQ ID NO: 3411 - protein, 36 aa, Artificial Sequence
  Antimicrobial peptide sequence
GLPWILLRWLFRFGDNNNNNNNGLPWILLRWLFRRG

SEQ ID NO: 3412 - protein, 35 aa, Artificial Sequence
  Antimicrobial peptide sequence
GLPWILLRWLFRFGDNGNGNGGLPWILLRWLFFRG

SEQ ID NO: 3413 - protein, 35 aa, Artificial Sequence
  Antimicrobial peptide sequence
GLPWILLRWLFRFGDNGNGNGGLARILLRWLFFRG

SEQ ID NO: 3414 - protein, 35 aa, Artificial Sequence
  Antimicrobial peptide sequence
GLPWILLRWLFRFGDNGNGNGGLARILLRWLFRFG

SEQ ID NO: 3415 - protein, 35 aa, Artificial Sequence
  Antimicrobial peptide sequence
GLPWILLRWLFRFGDNGNGNGGLVRILLRWLFRFG

SEQ ID NO: 3416 - protein, 35 aa, Artificial Sequence
  Antimicrobial peptide sequence
GLPWILLRWLFRFGDNGNGNGGLARILLRLLFFRG

SEQ ID NO: 3417 - protein, 35 aa, Artificial Sequence
  Antimicrobial peptide sequence
GLPWILLRWLFRFGDNGNGNGGLARILLRLLFRFG

SEQ ID NO: 3418 - protein, 35 aa, Artificial Sequence
  Antimicrobial peptide sequence
GLPWILLRWLFRFGDNGNGNGGLVRILLRLLFRFG

SEQ ID NO: 3419 - protein, 35 aa, Artificial Sequence
  Antimicrobial peptide sequence
GLPWILLRWLFRFGDNGNGNGSLVRILLRLLLRFG

SEQ ID NO: 3420 - protein, 35 aa, Artificial Sequence
  Antimicrobial peptide sequence
GLPWILLRWLFRFGDNGNGNGGLVRILLRLLLRYG

SEQ ID NO: 3421 - protein, 35 aa, Artificial Sequence
  Antimicrobial peptide sequence
GLPWILLRWLFRFGDNGNGNGGLAWILLRWLFFRG

SEQ ID NO: 3422 - protein, 35 aa, Artificial Sequence
  Antimicrobial peptide sequence
GLPWILLRWLFRFGDNGNGNGGLVRILLRWLFFRG

SEQ ID NO: 3423 - protein, 35 aa, Artificial Sequence
  Antimicrobial peptide sequence
GLPWILLRWLFRFGDNGNGNGGLLRILLRWLFFRG

SEQ ID NO: 3424 - protein, 35 aa, Artificial Sequence
  Antimicrobial peptide sequence
GLPWILLRWLFRFGDNGNGNGGLPWILLRWLFRFG

SEQ ID NO: 3425 - protein, 35 aa, Artificial Sequence
  Antimicrobial peptide sequence
GLPWILLRWLFRFGDNGNGNGGLLRILLRWLFRFG

SEQ ID NO: 3426 - protein, 35 aa, Artificial Sequence
  Antimicrobial peptide sequence
GLPWILLRWLFRFGDNGNGNGGLPWILLRWLFRRG

SEQ ID NO: 3427 - protein, 35 aa, Artificial Sequence
  Antimicrobial peptide sequence
GLPWILLRWLFRFGDGNGNGNGLPWILLRWLFFRG

SEQ ID NO: 3428 - protein, 35 aa, Artificial Sequence
  Antimicrobial peptide sequence
GLPWILLRWLFRFGDGNGNGNGLARILLRWLFFRG

SEQ ID NO: 3429 - protein, 35 aa, Artificial Sequence
  Antimicrobial peptide sequence
GLPWILLRWLFRFGDGNGNGNGLARILLRWLFRFG

SEQ ID NO: 3430 - protein, 35 aa, Artificial Sequence
  Antimicrobial peptide sequence
GLPWILLRWLFRFGDGNGNGNGLVRILLRWLFRFG

SEQ ID NO: 3431 - protein, 35 aa, Artificial Sequence
  Antimicrobial peptide sequence
GLPWILLRWLFRFGDGNGNGNGLARILLRLLFFRG

SEQ ID NO: 3432 - protein, 35 aa, Artificial Sequence
  Antimicrobial peptide sequence
GLPWILLRWLFRFGDGNGNGNGLARILLRLLFRFG

SEQ ID NO: 3433 - protein, 35 aa, Artificial Sequence
  Antimicrobial peptide sequence
GLPWILLRWLFRFGDGNGNGNGLVRILLRLLFRFG

SEQ ID NO: 3434 - protein, 35 aa, Artificial Sequence
  Antimicrobial peptide sequence
GLPWILLRWLFRFGDGNGNGNSLVRILLRLLLRFG

SEQ ID NO: 3435 - protein, 35 aa, Artificial Sequence
  Antimicrobial peptide sequence
GLPWILLRWLFRFGDGNGNGNGLVRILLRLLLRYG

SEQ ID NO: 3436 - protein, 35 aa, Artificial Sequence
  Antimicrobial peptide sequence
GLPWILLRWLFRFGDGNGNGNGLAWILLRWLFFRG

SEQ ID NO: 3437 - protein, 35 aa, Artificial Sequence
  Antimicrobial peptide sequence
GLPWILLRWLFRFGDGNGNGNGLVRILLRWLFFRG

SEQ ID NO: 3438 - protein, 35 aa, Artificial Sequence
  Antimicrobial peptide sequence
GLPWILLRWLFRFGDGNGNGNGLLRILLRWLFFRG

SEQ ID NO: 3439 - protein, 35 aa, Artificial Sequence
  Antimicrobial peptide sequence
GLPWILLRWLFRFGDGNGNGNGLPWILLRWLFRFG

SEQ ID NO: 3440 - protein, 35 aa, Artificial Sequence
  Antimicrobial peptide sequence
GLPWILLRWLFRFGDGNGNGNGLLRILLRWLFRFG

SEQ ID NO: 3441 - protein, 35 aa, Artificial Sequence
  Antimicrobial peptide sequence
GLPWILLRWLFRFGDGNGNGNGLPWILLRWLFRRG

SEQ ID NO: 3442 - protein, 35 aa, Artificial Sequence
  Antimicrobial peptide sequence
GLPWILLRWLFRFGDSGSGSGGLPWILLRWLFFRG

SEQ ID NO: 3443 - protein, 35 aa, Artificial Sequence
  Antimicrobial peptide sequence
GLPWILLRWLFRFGDSGSGSGGLARILLRWLFFRG

SEQ ID NO: 3444 - protein, 35 aa, Artificial Sequence
  Antimicrobial peptide sequence
GLPWILLRWLFRFGDSGSGSGGLARILLRWLFRFG

SEQ ID NO: 3445 - protein, 35 aa, Artificial Sequence
  Antimicrobial peptide sequence
GLPWILLRWLFRFGDSGSGSGGLVRILLRWLFRFG

SEQ ID NO: 3446 - protein, 35 aa, Artificial Sequence
  Antimicrobial peptide sequence
GLPWILLRWLFRFGDSGSGSGGLARILLRLLFFRG

SEQ ID NO: 3447 - protein, 35 aa, Artificial Sequence
  Antimicrobial peptide sequence
GLPWILLRWLFRFGDSGSGSGGLARILLRLLFRFG

SEQ ID NO: 3448 - protein, 35 aa, Artificial Sequence
  Antimicrobial peptide sequence
GLPWILLRWLFRFGDSGSGSGGLVRILLRLLFRFG

SEQ ID NO: 3449 - protein, 35 aa, Artificial Sequence
  Antimicrobial peptide sequence
GLPWILLRWLFRFGDSGSGSGSLVRILLRLLLRFG

SEQ ID NO: 3450 - protein, 35 aa, Artificial Sequence
  Antimicrobial peptide sequence
GLPWILLRWLFRFGDSGSGSGGLVRILLRLLLRYG

SEQ ID NO: 3451 - protein, 35 aa, Artificial Sequence
  Antimicrobial peptide sequence
GLPWILLRWLFRFGDSGSGSGGLAWILLRWLFFRG

SEQ ID NO: 3452 - protein, 35 aa, Artificial Sequence
  Antimicrobial peptide sequence
GLPWILLRWLFRFGDSGSGSGGLVRILLRWLFFRG

SEQ ID NO: 3453 - protein, 35 aa, Artificial Sequence
  Antimicrobial peptide sequence
GLPWILLRWLFRFGDSGSGSGGLLRILLRWLFFRG

SEQ ID NO: 3454 - protein, 35 aa, Artificial Sequence
  Antimicrobial peptide sequence
GLPWILLRWLFRFGDSGSGSGGLPWILLRWLFRFG

SEQ ID NO: 3455 - protein, 35 aa, Artificial Sequence
  Antimicrobial peptide sequence
GLPWILLRWLFRFGDSGSGSGGLLRILLRWLFRFG

SEQ ID NO: 3456 - protein, 35 aa, Artificial Sequence
  Antimicrobial peptide sequence
GLPWILLRWLFRFGDSGSGSGGLPWILLRWLFRRG

SEQ ID NO: 3457 - protein, 35 aa, Artificial Sequence
  Antimicrobial peptide sequence
GLPWILLRWLFRFGDGSGSGSGLPWILLRWLFFRG

SEQ ID NO: 3458 - protein, 35 aa, Artificial Sequence
  Antimicrobial peptide sequence
GLPWILLRWLFRFGDGSGSGSGLARILLRWLFFRG

SEQ ID NO: 3459 - protein, 35 aa, Artificial Sequence
  Antimicrobial peptide sequence
GLPWILLRWLFRFGDGSGSGSGLARILLRWLFRFG

SEQ ID NO: 3460 - protein, 35 aa, Artificial Sequence
  Antimicrobial peptide sequence
GLPWILLRWLFRFGDGSGSGSGLVRILLRWLFRFG

SEQ ID NO: 3461 - protein, 35 aa, Artificial Sequence
  Antimicrobial peptide sequence
GLPWILLRWLFRFGDGSGSGSGLARILLRLLFFRG

SEQ ID NO: 3462 - protein, 35 aa, Artificial Sequence
  Antimicrobial peptide sequence
GLPWILLRWLFRFGDGSGSGSGLARILLRLLFRFG

SEQ ID NO: 3463 - protein, 35 aa, Artificial Sequence
  Antimicrobial peptide sequence
GLPWILLRWLFRFGDGSGSGSGLVRILLRLLFRFG

SEQ ID NO: 3464 - protein, 35 aa, Artificial Sequence
  Antimicrobial peptide sequence
GLPWILLRWLFRFGDGSGSGSSLVRILLRLLLRFG

SEQ ID NO: 3465 - protein, 35 aa, Artificial Sequence
  Antimicrobial peptide sequence
GLPWILLRWLFRFGDGSGSGSGLVRILLRLLLRYG

SEQ ID NO: 3466 - protein, 35 aa, Artificial Sequence
  Antimicrobial peptide sequence
GLPWILLRWLFRFGDGSGSGSGLAWILLRWLFFRG

SEQ ID NO: 3467 - protein, 35 aa, Artificial Sequence
  Antimicrobial peptide sequence
GLPWILLRWLFRFGDGSGSGSGLVRILLRWLFFRG

SEQ ID NO: 3468 - protein, 35 aa, Artificial Sequence
  Antimicrobial peptide sequence
GLPWILLRWLFRFGDGSGSGSGLLRILLRWLFFRG

SEQ ID NO: 3469 - protein, 35 aa, Artificial Sequence
  Antimicrobial peptide sequence
GLPWILLRWLFRFGDGSGSGSGLPWILLRWLFRFG

SEQ ID NO: 3470 - protein, 35 aa, Artificial Sequence
  Antimicrobial peptide sequence
GLPWILLRWLFRFGDGSGSGSGLLRILLRWLFRFG

SEQ ID NO: 3471 - protein, 35 aa, Artificial Sequence
  Antimicrobial peptide sequence
GLPWILLRWLFRFGDGSGSGSGLPWILLRWLFRRG

SEQ ID NO: 3472 - protein, 35 aa, Artificial Sequence
  Antimicrobial peptide sequence
GLPWILLRWLFRFGDSNSNSNGLPWILLRWLFFRG

SEQ ID NO: 3473 - protein, 35 aa, Artificial Sequence
  Antimicrobial peptide sequence
GLPWILLRWLFRFGDSNSNSNGLARILLRWLFFRG

SEQ ID NO: 3474 - protein, 35 aa, Artificial Sequence
  Antimicrobial peptide sequence
GLPWILLRWLFRFGDSNSNSNGLARILLRWLFRFG

SEQ ID NO: 3475 - protein, 35 aa, Artificial Sequence
  Antimicrobial peptide sequence
GLPWILLRWLFRFGDSNSNSNGLVRILLRWLFRFG

SEQ ID NO: 3476 - protein, 35 aa, Artificial Sequence
  Antimicrobial peptide sequence
GLPWILLRWLFRFGDSNSNSNGLARILLRLLFFRG

SEQ ID NO: 3477 - protein, 35 aa, Artificial Sequence
  Antimicrobial peptide sequence
GLPWILLRWLFRFGDSNSNSNGLARILLRLLFRFG

SEQ ID NO: 3478 - protein, 35 aa, Artificial Sequence
  Antimicrobial peptide sequence
GLPWILLRWLFRFGDSNSNSNGLVRILLRLLFRFG

SEQ ID NO: 3479 - protein, 35 aa, Artificial Sequence
  Antimicrobial peptide sequence
GLPWILLRWLFRFGDSNSNSNSLVRILLRLLLRFG

SEQ ID NO: 3480 - protein, 35 aa, Artificial Sequence
  Antimicrobial peptide sequence
GLPWILLRWLFRFGDSNSNSNGLVRILLRLLLRYG

SEQ ID NO: 3481 - protein, 35 aa, Artificial Sequence
  Antimicrobial peptide sequence
GLPWILLRWLFRFGDSNSNSNGLAWILLRWLFFRG

SEQ ID NO: 3482 - protein, 35 aa, Artificial Sequence
  Antimicrobial peptide sequence
GLPWILLRWLFRFGDSNSNSNGLVRILLRWLFFRG

SEQ ID NO: 3483 - protein, 35 aa, Artificial Sequence
  Antimicrobial peptide sequence
GLPWILLRWLFRFGDSNSNSNGLLRILLRWLFFRG

SEQ ID NO: 3484 - protein, 35 aa, Artificial Sequence
  Antimicrobial peptide sequence
GLPWILLRWLFRFGDSNSNSNGLPWILLRWLFRFG

SEQ ID NO: 3485 - protein, 35 aa, Artificial Sequence
  Antimicrobial peptide sequence
GLPWILLRWLFRFGDSNSNSNGLLRILLRWLFRFG

SEQ ID NO: 3486 - protein, 35 aa, Artificial Sequence
  Antimicrobial peptide sequence
GLPWILLRWLFRFGDSNSNSNGLPWILLRWLFRRG

SEQ ID NO: 3487 - protein, 35 aa, Artificial Sequence
  Antimicrobial peptide sequence
GLPWILLRWLFRFGDNSNSNSGLPWILLRWLFFRG

SEQ ID NO: 3488 - protein, 35 aa, Artificial Sequence
  Antimicrobial peptide sequence
GLPWILLRWLFRFGDNSNSNSGLARILLRWLFFRG

SEQ ID NO: 3489 - protein, 35 aa, Artificial Sequence
  Antimicrobial peptide sequence
GLPWILLRWLFRFGDNSNSNSGLARILLRWLFRFG

SEQ ID NO: 3490 - protein, 35 aa, Artificial Sequence
  Antimicrobial peptide sequence
GLPWILLRWLFRFGDNSNSNSGLVRILLRWLFRFG

SEQ ID NO: 3491 - protein, 35 aa, Artificial Sequence
  Antimicrobial peptide sequence
GLPWILLRWLFRFGDNSNSNSGLARILLRLLFFRG

SEQ ID NO: 3492 - protein, 35 aa, Artificial Sequence
  Antimicrobial peptide sequence
GLPWILLRWLFRFGDNSNSNSGLARILLRLLFRFG

SEQ ID NO: 3493 - protein, 35 aa, Artificial Sequence
  Antimicrobial peptide sequence
GLPWILLRWLFRFGDNSNSNSGLVRILLRLLFRFG

SEQ ID NO: 3494 - protein, 35 aa, Artificial Sequence
  Antimicrobial peptide sequence
GLPWILLRWLFRFGDNSNSNSSLVRILLRLLLRFG

SEQ ID NO: 3495 - protein, 35 aa, Artificial Sequence
  Antimicrobial peptide sequence
GLPWILLRWLFRFGDNSNSNSGLVRILLRLLLRYG

SEQ ID NO: 3496 - protein, 35 aa, Artificial Sequence
  Antimicrobial peptide sequence
GLPWILLRWLFRFGDNSNSNSGLAWILLRWLFFRG

SEQ ID NO: 3497 - protein, 35 aa, Artificial Sequence
  Antimicrobial peptide sequence
GLPWILLRWLFRFGDNSNSNSGLVRILLRWLFFRG

SEQ ID NO: 3498 - protein, 35 aa, Artificial Sequence
  Antimicrobial peptide sequence
GLPWILLRWLFRFGDNSNSNSGLLRILLRWLFFRG

SEQ ID NO: 3499 - protein, 35 aa, Artificial Sequence
  Antimicrobial peptide sequence
GLPWILLRWLFRFGDNSNSNSGLPWILLRWLFRFG

SEQ ID NO: 3500 - protein, 35 aa, Artificial Sequence
  Antimicrobial peptide sequence
GLPWILLRWLFRFGDNSNSNSGLLRILLRWLFRFG

SEQ ID NO: 3501 - protein, 35 aa, Artificial Sequence
  Antimicrobial peptide sequence
GLPWILLRWLFRFGDNSNSNSGLPWILLRWLFRRG

SEQ ID NO: 3502 - protein, 35 aa, Artificial Sequence
  Antimicrobial peptide sequence
GLPWILLRWLFRFGDHGHGHGGLPWILLRWLFFRG

SEQ ID NO: 3503 - protein, 35 aa, Artificial Sequence
  Antimicrobial peptide sequence
GLPWILLRWLFRFGDHGHGHGGLARILLRWLFFRG

SEQ ID NO: 3504 - protein, 35 aa, Artificial Sequence
  Antimicrobial peptide sequence
GLPWILLRWLFRFGDHGHGHGGLARILLRWLFRFG

SEQ ID NO: 3505 - protein, 35 aa, Artificial Sequence
  Antimicrobial peptide sequence
GLPWILLRWLFRFGDHGHGHGGLVRILLRWLFRFG

SEQ ID NO: 3506 - protein, 35 aa, Artificial Sequence
  Antimicrobial peptide sequence
GLPWILLRWLFRFGDHGHGHGGLARILLRLLFFRG

SEQ ID NO: 3507 - protein, 35 aa, Artificial Sequence
  Antimicrobial peptide sequence
GLPWILLRWLFRFGDHGHGHGGLARILLRLLFRFG

SEQ ID NO: 3508 - protein, 35 aa, Artificial Sequence
  Antimicrobial peptide sequence
GLPWILLRWLFRFGDHGHGHGGLVRILLRLLFRFG

SEQ ID NO: 3509 - protein, 35 aa, Artificial Sequence
  Antimicrobial peptide sequence
GLPWILLRWLFRFGDHGHGHGSLVRILLRLLLRFG

SEQ ID NO: 3510 - protein, 35 aa, Artificial Sequence
  Antimicrobial peptide sequence
GLPWILLRWLFRFGDHGHGHGGLVRILLRLLLRYG

SEQ ID NO: 3511 - protein, 35 aa, Artificial Sequence
  Antimicrobial peptide sequence
GLPWILLRWLFRFGDHGHGHGGLAWILLRWLFFRG

SEQ ID NO: 3512 - protein, 35 aa, Artificial Sequence
  Antimicrobial peptide sequence
GLPWILLRWLFRFGDHGHGHGGLVRILLRWLFFRG

SEQ ID NO: 3513 - protein, 35 aa, Artificial Sequence
  Antimicrobial peptide sequence
GLPWILLRWLFRFGDHGHGHGGLLRILLRWLFFRG

SEQ ID NO: 3514 - protein, 35 aa, Artificial Sequence
  Antimicrobial peptide sequence
GLPWILLRWLFRFGDHGHGHGGLPWILLRWLFRFG

SEQ ID NO: 3515 - protein, 35 aa, Artificial Sequence
  Antimicrobial peptide sequence
GLPWILLRWLFRFGDHGHGHGGLLRILLRWLFRFG

SEQ ID NO: 3516 - protein, 35 aa, Artificial Sequence
  Antimicrobial peptide sequence
GLPWILLRWLFRFGDHGHGHGGLPWILLRWLFRRG

SEQ ID NO: 3517 - protein, 35 aa, Artificial Sequence
  Antimicrobial peptide sequence
GLPWILLRWLFRFGDGHGHGHGLPWILLRWLFFRG

SEQ ID NO: 3518 - protein, 35 aa, Artificial Sequence
  Antimicrobial peptide sequence
GLPWILLRWLFRFGDGHGHGHGLARILLRWLFFRG

SEQ ID NO: 3519 - protein, 35 aa, Artificial Sequence
  Antimicrobial peptide sequence
GLPWILLRWLFRFGDGHGHGHGLARILLRWLFRFG

SEQ ID NO: 3520 - protein, 35 aa, Artificial Sequence
  Antimicrobial peptide sequence
GLPWILLRWLFRFGDGHGHGHGLVRILLRWLFRFG

SEQ ID NO: 3521 - protein, 35 aa, Artificial Sequence
  Antimicrobial peptide sequence
GLPWILLRWLFRFGDGHGHGHGLARILLRLLFFRG

SEQ ID NO: 3522 - protein, 35 aa, Artificial Sequence
  Antimicrobial peptide sequence
GLPWILLRWLFRFGDGHGHGHGLARILLRLLFRFG

SEQ ID NO: 3523 - protein, 35 aa, Artificial Sequence
  Antimicrobial peptide sequence
GLPWILLRWLFRFGDGHGHGHGLVRILLRLLFRFG

SEQ ID NO: 3524 - protein, 35 aa, Artificial Sequence
  Antimicrobial peptide sequence
GLPWILLRWLFRFGDGHGHGHSLVRILLRLLLRFG

SEQ ID NO: 3525 - protein, 35 aa, Artificial Sequence
  Antimicrobial peptide sequence
GLPWILLRWLFRFGDGHGHGHGLVRILLRLLLRYG

SEQ ID NO: 3526 - protein, 35 aa, Artificial Sequence
  Antimicrobial peptide sequence
GLPWILLRWLFRFGDGHGHGHGLAWILLRWLFFRG

SEQ ID NO: 3527 - protein, 35 aa, Artificial Sequence
  Antimicrobial peptide sequence
GLPWILLRWLFRFGDGHGHGHGLVRILLRWLFFRG

SEQ ID NO: 3528 - protein, 35 aa, Artificial Sequence
  Antimicrobial peptide sequence
GLPWILLRWLFRFGDGHGHGHGLLRILLRWLFFRG

SEQ ID NO: 3529 - protein, 35 aa, Artificial Sequence
  Antimicrobial peptide sequence
GLPWILLRWLFRFGDGHGHGHGLPWILLRWLFRFG

SEQ ID NO: 3530 - protein, 35 aa, Artificial Sequence
  Antimicrobial peptide sequence
GLPWILLRWLFRFGDGHGHGHGLLRILLRWLFRFG

SEQ ID NO: 3531 - protein, 35 aa, Artificial Sequence
  Antimicrobial peptide sequence
GLPWILLRWLFRFGDGHGHGHGLPWILLRWLFRRG

SEQ ID NO: 3532 - protein, 35 aa, Artificial Sequence
  Antimicrobial peptide sequence
GLPWILLRWLFRFGDHNHNHNGLPWILLRWLFFRG

SEQ ID NO: 3533 - protein, 35 aa, Artificial Sequence
  Antimicrobial peptide sequence
GLPWILLRWLFRFGDHNHNHNGLARILLRWLFFRG

SEQ ID NO: 3534 - protein, 35 aa, Artificial Sequence
  Antimicrobial peptide sequence
GLPWILLRWLFRFGDHNHNHNGLARILLRWLFRFG

SEQ ID NO: 3535 - protein, 35 aa, Artificial Sequence
  Antimicrobial peptide sequence
GLPWILLRWLFRFGDHNHNHNGLVRILLRWLFRFG

SEQ ID NO: 3536 - protein, 35 aa, Artificial Sequence
  Antimicrobial peptide sequence
GLPWILLRWLFRFGDHNHNHNGLARILLRLLFFRG

SEQ ID NO: 3537 - protein, 35 aa, Artificial Sequence
  Antimicrobial peptide sequence
GLPWILLRWLFRFGDHNHNHNGLARILLRLLFRFG

SEQ ID NO: 3538 - protein, 35 aa, Artificial Sequence
  Antimicrobial peptide sequence
GLPWILLRWLFRFGDHNHNHNGLVRILLRLLFRFG

SEQ ID NO: 3539 - protein, 35 aa, Artificial Sequence
  Antimicrobial peptide sequence
GLPWILLRWLFRFGDHNHNHNSLVRILLRLLLRFG

SEQ ID NO: 3540 - protein, 35 aa, Artificial Sequence
  Antimicrobial peptide sequence
GLPWILLRWLFRFGDHNHNHNGLVRILLRLLLRYG

SEQ ID NO: 3541 - protein, 35 aa, Artificial Sequence
  Antimicrobial peptide sequence
GLPWILLRWLFRFGDHNHNHNGLAWILLRWLFFRG

SEQ ID NO: 3542 - protein, 35 aa, Artificial Sequence
  Antimicrobial peptide sequence
GLPWILLRWLFRFGDHNHNHNGLVRILLRWLFFRG

SEQ ID NO: 3543 - protein, 35 aa, Artificial Sequence
  Antimicrobial peptide sequence
GLPWILLRWLFRFGDHNHNHNGLLRILLRWLFFRG

SEQ ID NO: 3544 - protein, 35 aa, Artificial Sequence
  Antimicrobial peptide sequence
GLPWILLRWLFRFGDHNHNHNGLPWILLRWLFRFG

SEQ ID NO: 3545 - protein, 35 aa, Artificial Sequence
  Antimicrobial peptide sequence
GLPWILLRWLFRFGDHNHNHNGLLRILLRWLFRFG

SEQ ID NO: 3546 - protein, 35 aa, Artificial Sequence
  Antimicrobial peptide sequence
GLPWILLRWLFRFGDHNHNHNGLPWILLRWLFRRG

SEQ ID NO: 3547 - protein, 35 aa, Artificial Sequence
  Antimicrobial peptide sequence
GLPWILLRWLFRFGDNHNHNHGLPWILLRWLFFRG

SEQ ID NO: 3548 - protein, 35 aa, Artificial Sequence
  Antimicrobial peptide sequence
GLPWILLRWLFRFGDNHNHNHGLARILLRWLFFRG

SEQ ID NO: 3549 - protein, 35 aa, Artificial Sequence
  Antimicrobial peptide sequence
GLPWILLRWLFRFGDNHNHNHGLARILLRWLFRFG

SEQ ID NO: 3550 - protein, 35 aa, Artificial Sequence
  Antimicrobial peptide sequence
GLPWILLRWLFRFGDNHNHNHGLVRILLRWLFRFG

SEQ ID NO: 3551 - protein, 35 aa, Artificial Sequence
  Antimicrobial peptide sequence
GLPWILLRWLFRFGDNHNHNHGLARILLRLLFFRG

SEQ ID NO: 3552 - protein, 35 aa, Artificial Sequence
  Antimicrobial peptide sequence
GLPWILLRWLFRFGDNHNHNHGLARILLRLLFRFG

SEQ ID NO: 3553 - protein, 35 aa, Artificial Sequence
  Antimicrobial peptide sequence
GLPWILLRWLFRFGDNHNHNHGLVRILLRLLFRFG

SEQ ID NO: 3554 - protein, 35 aa, Artificial Sequence
  Antimicrobial peptide sequence
GLPWILLRWLFRFGDNHNHNHSLVRILLRLLLRFG

SEQ ID NO: 3555 - protein, 35 aa, Artificial Sequence
  Antimicrobial peptide sequence
GLPWILLRWLFRFGDNHNHNHGLVRILLRLLLRYG

SEQ ID NO: 3556 - protein, 35 aa, Artificial Sequence
  Antimicrobial peptide sequence
GLPWILLRWLFRFGDNHNHNHGLAWILLRWLFFRG

SEQ ID NO: 3557 - protein, 35 aa, Artificial Sequence
  Antimicrobial peptide sequence
GLPWILLRWLFRFGDNHNHNHGLVRILLRWLFFRG

SEQ ID NO: 3558 - protein, 35 aa, Artificial Sequence
  Antimicrobial peptide sequence
GLPWILLRWLFRFGDNHNHNHGLLRILLRWLFFRG

SEQ ID NO: 3559 - protein, 35 aa, Artificial Sequence
  Antimicrobial peptide sequence
GLPWILLRWLFRFGDNHNHNHGLPWILLRWLFRFG

SEQ ID NO: 3560 - protein, 35 aa, Artificial Sequence
  Antimicrobial peptide sequence
GLPWILLRWLFRFGDNHNHNHGLLRILLRWLFRFG

SEQ ID NO: 3561 - protein, 35 aa, Artificial Sequence
  Antimicrobial peptide sequence
GLPWILLRWLFRFGDNHNHNHGLPWILLRWLFRRG

SEQ ID NO: 3562 - protein, 33 aa, Artificial Sequence
  Antimicrobial peptide sequence
GLLRILLRWLFRFGDGGGGGLPWILLRWLFFRG

SEQ ID NO: 3563 - protein, 33 aa, Artificial Sequence
  Antimicrobial peptide sequence
GLLRILLRWLFRFGDGGGGGLARILLRWLFFRG

SEQ ID NO: 3564 - protein, 33 aa, Artificial Sequence
  Antimicrobial peptide sequence
GLLRILLRWLFRFGDGGGGGLARILLRWLFRFG

SEQ ID NO: 3565 - protein, 33 aa, Artificial Sequence
  Antimicrobial peptide sequence
GLLRILLRWLFRFGDGGGGGLVRILLRWLFRFG

SEQ ID NO: 3566 - protein, 33 aa, Artificial Sequence
  Antimicrobial peptide sequence
GLLRILLRWLFRFGDGGGGGLARILLRLLFFRG

SEQ ID NO: 3567 - protein, 33 aa, Artificial Sequence
  Antimicrobial peptide sequence
GLLRILLRWLFRFGDGGGGGLARILLRLLFRFG

SEQ ID NO: 3568 - protein, 33 aa, Artificial Sequence
  Antimicrobial peptide sequence
GLLRILLRWLFRFGDGGGGGLVRILLRLLFRFG

SEQ ID NO: 3569 - protein, 33 aa, Artificial Sequence
  Antimicrobial peptide sequence
GLLRILLRWLFRFGDGGGGSLVRILLRLLLRFG

SEQ ID NO: 3570 - protein, 33 aa, Artificial Sequence
  Antimicrobial peptide sequence
GLLRILLRWLFRFGDGGGGGLVRILLRLLLRYG

SEQ ID NO: 3571 - protein, 33 aa, Artificial Sequence
  Antimicrobial peptide sequence
GLLRILLRWLFRFGDGGGGGLAWILLRWLFFRG

SEQ ID NO: 3572 - protein, 33 aa, Artificial Sequence
  Antimicrobial peptide sequence
GLLRILLRWLFRFGDGGGGGLVRILLRWLFFRG

SEQ ID NO: 3573 - protein, 33 aa, Artificial Sequence
  Antimicrobial peptide sequence
GLLRILLRWLFRFGDGGGGGLLRILLRWLFFRG

SEQ ID NO: 3574 - protein, 33 aa, Artificial Sequence
  Antimicrobial peptide sequence
GLLRILLRWLFRFGDGGGGGLPWILLRWLFRFG

SEQ ID NO: 3575 - protein, 33 aa, Artificial Sequence
  Antimicrobial peptide sequence
GLLRILLRWLFRFGDGGGGGLLRILLRWLFRFG

SEQ ID NO: 3576 - protein, 33 aa, Artificial Sequence
  Antimicrobial peptide sequence
GLLRILLRWLFRFGDGGGGGLPWILLRWLFRRG

SEQ ID NO: 3577 - protein, 34 aa, Artificial Sequence
  Antimicrobial peptide sequence
GLLRILLRWLFRFGDGGGGGGLPWILLRWLFFRG

SEQ ID NO: 3578 - protein, 34 aa, Artificial Sequence
  Antimicrobial peptide sequence
GLLRILLRWLFRFGDGGGGGGLARILLRWLFFRG

SEQ ID NO: 3579 - protein, 34 aa, Artificial Sequence
  Antimicrobial peptide sequence
GLLRILLRWLFRFGDGGGGGGLARILLRWLFRFG

SEQ ID NO: 3580 - protein, 34 aa, Artificial Sequence
  Antimicrobial peptide sequence
GLLRILLRWLFRFGDGGGGGGLVRILLRWLFRFG

SEQ ID NO: 3581 - protein, 34 aa, Artificial Sequence
  Antimicrobial peptide sequence
GLLRILLRWLFRFGDGGGGGGLARILLRLLFFRG

SEQ ID NO: 3582 - protein, 34 aa, Artificial Sequence
  Antimicrobial peptide sequence
GLLRILLRWLFRFGDGGGGGGLARILLRLLFRFG

SEQ ID NO: 3583 - protein, 34 aa, Artificial Sequence
  Antimicrobial peptide sequence
GLLRILLRWLFRFGDGGGGGGLVRILLRLLFRFG

SEQ ID NO: 3584 - protein, 34 aa, Artificial Sequence
  Antimicrobial peptide sequence
GLLRILLRWLFRFGDGGGGGSLVRILLRLLLRFG

SEQ ID NO: 3585 - protein, 34 aa, Artificial Sequence
  Antimicrobial peptide sequence
GLLRILLRWLFRFGDGGGGGGLVRILLRLLLRYG

SEQ ID NO: 3586 - protein, 34 aa, Artificial Sequence
  Antimicrobial peptide sequence
GLLRILLRWLFRFGDGGGGGGLAWILLRWLFFRG

SEQ ID NO: 3587 - protein, 34 aa, Artificial Sequence
  Antimicrobial peptide sequence
GLLRILLRWLFRFGDGGGGGGLVRILLRWLFFRG

SEQ ID NO: 3588 - protein, 34 aa, Artificial Sequence
  Antimicrobial peptide sequence
GLLRILLRWLFRFGDGGGGGGLLRILLRWLFFRG

SEQ ID NO: 3589 - protein, 34 aa, Artificial Sequence
  Antimicrobial peptide sequence
GLLRILLRWLFRFGDGGGGGGLPWILLRWLFRFG

SEQ ID NO: 3590 - protein, 34 aa, Artificial Sequence
  Antimicrobial peptide sequence
GLLRILLRWLFRFGDGGGGGGLLRILLRWLFRFG

SEQ ID NO: 3591 - protein, 34 aa, Artificial Sequence
  Antimicrobial peptide sequence
GLLRILLRWLFRFGDGGGGGGLPWILLRWLFRRG

SEQ ID NO: 3592 - protein, 35 aa, Artificial Sequence
  Antimicrobial peptide sequence
GLLRILLRWLFRFGDGGGGGGGLPWILLRWLFFRG

SEQ ID NO: 3593 - protein, 35 aa, Artificial Sequence
  Antimicrobial peptide sequence
GLLRILLRWLFRFGDGGGGGGGLARILLRWLFFRG

SEQ ID NO: 3594 - protein, 35 aa, Artificial Sequence
  Antimicrobial peptide sequence
GLLRILLRWLFRFGDGGGGGGGLARILLRWLFRFG

SEQ ID NO: 3595 - protein, 35 aa, Artificial Sequence
  Antimicrobial peptide sequence
GLLRILLRWLFRFGDGGGGGGGLVRILLRWLFRFG

SEQ ID NO: 3596 - protein, 35 aa, Artificial Sequence
  Antimicrobial peptide sequence
GLLRILLRWLFRFGDGGGGGGGLARILLRLLFFRG

SEQ ID NO: 3597 - protein, 35 aa, Artificial Sequence
  Antimicrobial peptide sequence
GLLRILLRWLFRFGDGGGGGGGLARILLRLLFRFG

SEQ ID NO: 3598 - protein, 35 aa, Artificial Sequence
  Antimicrobial peptide sequence
GLLRILLRWLFRFGDGGGGGGGLVRILLRLLFRFG

SEQ ID NO: 3599 - protein, 35 aa, Artificial Sequence
  Antimicrobial peptide sequence
GLLRILLRWLFRFGDGGGGGGSLVRILLRLLLRFG

SEQ ID NO: 3600 - protein, 35 aa, Artificial Sequence
  Antimicrobial peptide sequence
GLLRILLRWLFRFGDGGGGGGGLVRILLRLLLRYG

SEQ ID NO: 3601 - protein, 35 aa, Artificial Sequence
  Antimicrobial peptide sequence
GLLRILLRWLFRFGDGGGGGGGLAWILLRWLFFRG

SEQ ID NO: 3602 - protein, 35 aa, Artificial Sequence
  Antimicrobial peptide sequence
GLLRILLRWLFRFGDGGGGGGGLVRILLRWLFFRG

SEQ ID NO: 3603 - protein, 35 aa, Artificial Sequence
  Antimicrobial peptide sequence
GLLRILLRWLFRFGDGGGGGGGLLRILLRWLFFRG

SEQ ID NO: 3604 - protein, 35 aa, Artificial Sequence
  Antimicrobial peptide sequence
GLLRILLRWLFRFGDGGGGGGGLPWILLRWLFRFG

SEQ ID NO: 3605 - protein, 35 aa, Artificial Sequence
  Antimicrobial peptide sequence
GLLRILLRWLFRFGDGGGGGGGLLRILLRWLFRFG

SEQ ID NO: 3606 - protein, 35 aa, Artificial Sequence
  Antimicrobial peptide sequence
GLLRILLRWLFRFGDGGGGGGGLPWILLRWLFRRG

SEQ ID NO: 3607 - protein, 36 aa, Artificial Sequence
  Antimicrobial peptide sequence
GLLRILLRWLFRFGDGGGGGGGGLPWILLRWLFFRG

SEQ ID NO: 3608 - protein, 36 aa, Artificial Sequence
  Antimicrobial peptide sequence
GLLRILLRWLFRFGDGGGGGGGGLARILLRWLFFRG

SEQ ID NO: 3609 - protein, 36 aa, Artificial Sequence
  Antimicrobial peptide sequence
GLLRILLRWLFRFGDGGGGGGGGLARILLRWLFRFG

SEQ ID NO: 3610 - protein, 36 aa, Artificial Sequence
  Antimicrobial peptide sequence
GLLRILLRWLFRFGDGGGGGGGGLVRILLRWLFRFG

SEQ ID NO: 3611 - protein, 36 aa, Artificial Sequence
  Antimicrobial peptide sequence
GLLRILLRWLFRFGDGGGGGGGGLARILLRLLFFRG

SEQ ID NO: 3612 - protein, 36 aa, Artificial Sequence
  Antimicrobial peptide sequence
GLLRILLRWLFRFGDGGGGGGGGLARILLRLLFRFG

SEQ ID NO: 3613 - protein, 36 aa, Artificial Sequence
  Antimicrobial peptide sequence
GLLRILLRWLFRFGDGGGGGGGGLVRILLRLLFRFG

SEQ ID NO: 3614 - protein, 36 aa, Artificial Sequence
  Antimicrobial peptide sequence
GLLRILLRWLFRFGDGGGGGGGSLVRILLRLLLRFG

SEQ ID NO: 3615 - protein, 36 aa, Artificial Sequence
  Antimicrobial peptide sequence
GLLRILLRWLFRFGDGGGGGGGGLVRILLRLLLRYG

SEQ ID NO: 3616 - protein, 36 aa, Artificial Sequence
  Antimicrobial peptide sequence
GLLRILLRWLFRFGDGGGGGGGGLAWILLRWLFFRG

SEQ ID NO: 3617 - protein, 36 aa, Artificial Sequence
  Antimicrobial peptide sequence
GLLRILLRWLFRFGDGGGGGGGGLVRILLRWLFFRG

SEQ ID NO: 3618 - protein, 36 aa, Artificial Sequence
  Antimicrobial peptide sequence
GLLRILLRWLFRFGDGGGGGGGGLLRILLRWLFFRG

SEQ ID NO: 3619 - protein, 36 aa, Artificial Sequence
  Antimicrobial peptide sequence
GLLRILLRWLFRFGDGGGGGGGGLPWILLRWLFRFG

SEQ ID NO: 3620 - protein, 36 aa, Artificial Sequence
  Antimicrobial peptide sequence
GLLRILLRWLFRFGDGGGGGGGGLLRILLRWLFRFG

SEQ ID NO: 3621 - protein, 36 aa, Artificial Sequence
  Antimicrobial peptide sequence
GLLRILLRWLFRFGDGGGGGGGGLPWILLRWLFRRG

SEQ ID NO: 3622 - protein, 33 aa, Artificial Sequence
  Antimicrobial peptide sequence
GLLRILLRWLFRFGDNNNNGLPWILLRWLFFRG

SEQ ID NO: 3623 - protein, 33 aa, Artificial Sequence
  Antimicrobial peptide sequence
GLLRILLRWLFRFGDNNNNGLARILLRWLFFRG

SEQ ID NO: 3624 - protein, 33 aa, Artificial Sequence
  Antimicrobial peptide sequence
GLLRILLRWLFRFGDNNNNGLARILLRWLFRFG

SEQ ID NO: 3625 - protein, 33 aa, Artificial Sequence
  Antimicrobial peptide sequence
GLLRILLRWLFRFGDNNNNGLVRILLRWLFRFG

SEQ ID NO: 3626 - protein, 33 aa, Artificial Sequence
  Antimicrobial peptide sequence
GLLRILLRWLFRFGDNNNNGLARILLRLLFFRG

SEQ ID NO: 3627 - protein, 33 aa, Artificial Sequence
  Antimicrobial peptide sequence
GLLRILLRWLFRFGDNNNNGLARILLRLLFRFG

SEQ ID NO: 3628 - protein, 33 aa, Artificial Sequence
  Antimicrobial peptide sequence
GLLRILLRWLFRFGDNNNNGLVRILLRLLFRFG

SEQ ID NO: 3629 - protein, 33 aa, Artificial Sequence
  Antimicrobial peptide sequence
GLLRILLRWLFRFGDNNNNSLVRILLRLLLRFG

SEQ ID NO: 3630 - protein, 33 aa, Artificial Sequence
  Antimicrobial peptide sequence
GLLRILLRWLFRFGDNNNNGLVRILLRLLLRYG

SEQ ID NO: 3631 - protein, 33 aa, Artificial Sequence
  Antimicrobial peptide sequence
GLLRILLRWLFRFGDNNNNGLAWILLRWLFFRG

SEQ ID NO: 3632 - protein, 33 aa, Artificial Sequence
  Antimicrobial peptide sequence
GLLRILLRWLFRFGDNNNNGLVRILLRWLFFRG

SEQ ID NO: 3633 - protein, 33 aa, Artificial Sequence
  Antimicrobial peptide sequence
GLLRILLRWLFRFGDNNNNGLLRILLRWLFFRG

SEQ ID NO: 3634 - protein, 33 aa, Artificial Sequence
  Antimicrobial peptide sequence
GLLRILLRWLFRFGDNNNNGLPWILLRWLFRFG

SEQ ID NO: 3635 - protein, 33 aa, Artificial Sequence
  Antimicrobial peptide sequence
GLLRILLRWLFRFGDNNNNGLLRILLRWLFRFG

SEQ ID NO: 3636 - protein, 33 aa, Artificial Sequence
  Antimicrobial peptide sequence
GLLRILLRWLFRFGDNNNNGLPWILLRWLFRRG

SEQ ID NO: 3637 - protein, 34 aa, Artificial Sequence
  Antimicrobial peptide sequence
GLLRILLRWLFRFGDNNNNNGLPWILLRWLFFRG

SEQ ID NO: 3638 - protein, 34 aa, Artificial Sequence
  Antimicrobial peptide sequence
GLLRILLRWLFRFGDNNNNNGLARILLRWLFFRG

SEQ ID NO: 3639 - protein, 34 aa, Artificial Sequence
  Antimicrobial peptide sequence
GLLRILLRWLFRFGDNNNNNGLARILLRWLFRFG

SEQ ID NO: 3640 - protein, 34 aa, Artificial Sequence
  Antimicrobial peptide sequence
GLLRILLRWLFRFGDNNNNNGLVRILLRWLFRFG

SEQ ID NO: 3641 - protein, 34 aa, Artificial Sequence
  Antimicrobial peptide sequence
GLLRILLRWLFRFGDNNNNNGLARILLRLLFFRG

SEQ ID NO: 3642 - protein, 34 aa, Artificial Sequence
  Antimicrobial peptide sequence
GLLRILLRWLFRFGDNNNNNGLARILLRLLFRFG

SEQ ID NO: 3643 - protein, 34 aa, Artificial Sequence
  Antimicrobial peptide sequence
GLLRILLRWLFRFGDNNNNNGLVRILLRLLFRFG

SEQ ID NO: 3644 - protein, 34 aa, Artificial Sequence
  Antimicrobial peptide sequence
GLLRILLRWLFRFGDNNNNNSLVRILLRLLLRFG

SEQ ID NO: 3645 - protein, 34 aa, Artificial Sequence
  Antimicrobial peptide sequence
GLLRILLRWLFRFGDNNNNNGLVRILLRLLLRYG

SEQ ID NO: 3646 - protein, 34 aa, Artificial Sequence
  Antimicrobial peptide sequence
GLLRILLRWLFRFGDNNNNNGLAWILLRWLFFRG

SEQ ID NO: 3647 - protein, 34 aa, Artificial Sequence
  Antimicrobial peptide sequence
GLLRILLRWLFRFGDNNNNNGLVRILLRWLFFRG

SEQ ID NO: 3648 - protein, 34 aa, Artificial Sequence
  Antimicrobial peptide sequence
GLLRILLRWLFRFGDNNNNNGLLRILLRWLFFRG

SEQ ID NO: 3649 - protein, 34 aa, Artificial Sequence
  Antimicrobial peptide sequence
GLLRILLRWLFRFGDNNNNNGLPWILLRWLFRFG

SEQ ID NO: 3650 - protein, 34 aa, Artificial Sequence
  Antimicrobial peptide sequence
GLLRILLRWLFRFGDNNNNNGLLRILLRWLFRFG

SEQ ID NO: 3651 - protein, 34 aa, Artificial Sequence
  Antimicrobial peptide sequence
GLLRILLRWLFRFGDNNNNNGLPWILLRWLFRRG

SEQ ID NO: 3652 - protein, 35 aa, Artificial Sequence
  Antimicrobial peptide sequence
GLLRILLRWLFRFGDNNNNNNGLPWILLRWLFFRG

SEQ ID NO: 3653 - protein, 35 aa, Artificial Sequence
  Antimicrobial peptide sequence
GLLRILLRWLFRFGDNNNNNNGLARILLRWLFFRG

SEQ ID NO: 3654 - protein, 35 aa, Artificial Sequence
  Antimicrobial peptide sequence
GLLRILLRWLFRFGDNNNNNNGLARILLRWLFRFG

SEQ ID NO: 3655 - protein, 35 aa, Artificial Sequence
  Antimicrobial peptide sequence
GLLRILLRWLFRFGDNNNNNNGLVRILLRWLFRFG

SEQ ID NO: 3656 - protein, 35 aa, Artificial Sequence
  Antimicrobial peptide sequence
GLLRILLRWLFRFGDNNNNNNGLARILLRLLFFRG

SEQ ID NO: 3657 - protein, 35 aa, Artificial Sequence
  Antimicrobial peptide sequence
GLLRILLRWLFRFGDNNNNNNGLARILLRLLFRFG

SEQ ID NO: 3658 - protein, 35 aa, Artificial Sequence
  Antimicrobial peptide sequence
GLLRILLRWLFRFGDNNNNNNGLVRILLRLLFRFG

SEQ ID NO: 3659 - protein, 35 aa, Artificial Sequence
  Antimicrobial peptide sequence
GLLRILLRWLFRFGDNNNNNNSLVRILLRLLLRFG

SEQ ID NO: 3660 - protein, 35 aa, Artificial Sequence
  Antimicrobial peptide sequence
GLLRILLRWLFRFGDNNNNNNGLVRILLRLLLRYG

SEQ ID NO: 3661 - protein, 35 aa, Artificial Sequence
  Antimicrobial peptide sequence
GLLRILLRWLFRFGDNNNNNNGLAWILLRWLFFRG

SEQ ID NO: 3662 - protein, 35 aa, Artificial Sequence
  Antimicrobial peptide sequence
GLLRILLRWLFRFGDNNNNNNGLVRILLRWLFFRG

SEQ ID NO: 3663 - protein, 35 aa, Artificial Sequence
  Antimicrobial peptide sequence
GLLRILLRWLFRFGDNNNNNNGLLRILLRWLFFRG

SEQ ID NO: 3664 - protein, 35 aa, Artificial Sequence
  Antimicrobial peptide sequence
GLLRILLRWLFRFGDNNNNNNGLPWILLRWLFRFG

SEQ ID NO: 3665 - protein, 35 aa, Artificial Sequence
  Antimicrobial peptide sequence
GLLRILLRWLFRFGDNNNNNNGLLRILLRWLFRFG

SEQ ID NO: 3666 - protein, 35 aa, Artificial Sequence
  Antimicrobial peptide sequence
GLLRILLRWLFRFGDNNNNNNGLPWILLRWLFRRG

SEQ ID NO: 3667 - protein, 36 aa, Artificial Sequence
  Antimicrobial peptide sequence
GLLRILLRWLFRFGDNNNNNNNGLPWILLRWLFFRG

SEQ ID NO: 3668 - protein, 36 aa, Artificial Sequence
  Antimicrobial peptide sequence
GLLRILLRWLFRFGDNNNNNNNGLARILLRWLFFRG

SEQ ID NO: 3669 - protein, 36 aa, Artificial Sequence
  Antimicrobial peptide sequence
GLLRILLRWLFRFGDNNNNNNNGLARILLRWLFRFG

SEQ ID NO: 3670 - protein, 36 aa, Artificial Sequence
  Antimicrobial peptide sequence
GLLRILLRWLFRFGDNNNNNNNGLVRILLRWLFRFG

SEQ ID NO: 3671 - protein, 36 aa, Artificial Sequence
  Antimicrobial peptide sequence
GLLRILLRWLFRFGDNNNNNNNGLARILLRLLFFRG

SEQ ID NO: 3672 - protein, 36 aa, Artificial Sequence
  Antimicrobial peptide sequence
GLLRILLRWLFRFGDNNNNNNNGLARILLRLLFRFG

SEQ ID NO: 3673 - protein, 36 aa, Artificial Sequence
  Antimicrobial peptide sequence
GLLRILLRWLFRFGDNNNNNNNGLVRILLRLLFRFG

SEQ ID NO: 3674 - protein, 36 aa, Artificial Sequence
  Antimicrobial peptide sequence
GLLRILLRWLFRFGDNNNNNNNSLVRILLRLLLRFG

SEQ ID NO: 3675 - protein, 36 aa, Artificial Sequence
  Antimicrobial peptide sequence
GLLRILLRWLFRFGDNNNNNNNGLVRILLRLLLRYG

SEQ ID NO: 3676 - protein, 36 aa, Artificial Sequence
  Antimicrobial peptide sequence
GLLRILLRWLFRFGDNNNNNNNGLAWILLRWLFFRG

SEQ ID NO: 3677 - protein, 36 aa, Artificial Sequence
  Antimicrobial peptide sequence
GLLRILLRWLFRFGDNNNNNNNGLVRILLRWLFFRG

SEQ ID NO: 3678 - protein, 36 aa, Artificial Sequence
  Antimicrobial peptide sequence
GLLRILLRWLFRFGDNNNNNNNGLLRILLRWLFFRG

SEQ ID NO: 3679 - protein, 36 aa, Artificial Sequence
  Antimicrobial peptide sequence
GLLRILLRWLFRFGDNNNNNNNGLPWILLRWLFRFG

SEQ ID NO: 3680 - protein, 36 aa, Artificial Sequence
  Antimicrobial peptide sequence
GLLRILLRWLFRFGDNNNNNNNGLLRILLRWLFRFG

SEQ ID NO: 3681 - protein, 36 aa, Artificial Sequence
  Antimicrobial peptide sequence
GLLRILLRWLFRFGDNNNNNNNGLPWILLRWLFRRG

SEQ ID NO: 3682 - protein, 35 aa, Artificial Sequence
  Antimicrobial peptide sequence
GLLRILLRWLFRFGDNGNGNGGLPWILLRWLFFRG

SEQ ID NO: 3683 - protein, 35 aa, Artificial Sequence
  Antimicrobial peptide sequence
GLLRILLRWLFRFGDNGNGNGGLARILLRWLFFRG

SEQ ID NO: 3684 - protein, 35 aa, Artificial Sequence
  Antimicrobial peptide sequence
GLLRILLRWLFRFGDNGNGNGGLARILLRWLFRFG

SEQ ID NO: 3685 - protein, 35 aa, Artificial Sequence
  Antimicrobial peptide sequence
GLLRILLRWLFRFGDNGNGNGGLVRILLRWLFRFG

SEQ ID NO: 3686 - protein, 35 aa, Artificial Sequence
  Antimicrobial peptide sequence
GLLRILLRWLFRFGDNGNGNGGLARILLRLLFFRG

SEQ ID NO: 3687 - protein, 35 aa, Artificial Sequence
  Antimicrobial peptide sequence
GLLRILLRWLFRFGDNGNGNGGLARILLRLLFRFG

SEQ ID NO: 3688 - protein, 35 aa, Artificial Sequence
  Antimicrobial peptide sequence
GLLRILLRWLFRFGDNGNGNGGLVRILLRLLFRFG

SEQ ID NO: 3689 - protein, 35 aa, Artificial Sequence
  Antimicrobial peptide sequence
GLLRILLRWLFRFGDNGNGNGSLVRILLRLLLRFG

SEQ ID NO: 3690 - protein, 35 aa, Artificial Sequence
  Antimicrobial peptide sequence
GLLRILLRWLFRFGDNGNGNGGLVRILLRLLLRYG

SEQ ID NO: 3691 - protein, 35 aa, Artificial Sequence
  Antimicrobial peptide sequence
GLLRILLRWLFRFGDNGNGNGGLAWILLRWLFFRG

SEQ ID NO: 3692 - protein, 35 aa, Artificial Sequence
  Antimicrobial peptide sequence
GLLRILLRWLFRFGDNGNGNGGLVRILLRWLFFRG

SEQ ID NO: 3693 - protein, 35 aa, Artificial Sequence
  Antimicrobial peptide sequence
GLLRILLRWLFRFGDNGNGNGGLLRILLRWLFFRG

SEQ ID NO: 3694 - protein, 35 aa, Artificial Sequence
  Antimicrobial peptide sequence
GLLRILLRWLFRFGDNGNGNGGLPWILLRWLFRFG

SEQ ID NO: 3695 - protein, 35 aa, Artificial Sequence
  Antimicrobial peptide sequence
GLLRILLRWLFRFGDNGNGNGGLLRILLRWLFRFG

SEQ ID NO: 3696 - protein, 35 aa, Artificial Sequence
  Antimicrobial peptide sequence
GLLRILLRWLFRFGDNGNGNGGLPWILLRWLFRRG

SEQ ID NO: 3697 - protein, 35 aa, Artificial Sequence
  Antimicrobial peptide sequence
GLLRILLRWLFRFGDGNGNGNGLPWILLRWLFFRG

SEQ ID NO: 3698 - protein, 35 aa, Artificial Sequence
  Antimicrobial peptide sequence
GLLRILLRWLFRFGDGNGNGNGLARILLRWLFFRG

SEQ ID NO: 3699 - protein, 35 aa, Artificial Sequence
  Antimicrobial peptide sequence
GLLRILLRWLFRFGDGNGNGNGLARILLRWLFRFG

SEQ ID NO: 3700 - protein, 35 aa, Artificial Sequence
  Antimicrobial peptide sequence
GLLRILLRWLFRFGDGNGNGNGLVRILLRWLFRFG

SEQ ID NO: 3701 - protein, 35 aa, Artificial Sequence
  Antimicrobial peptide sequence
GLLRILLRWLFRFGDGNGNGNGLARILLRLLFFRG

SEQ ID NO: 3702 - protein, 35 aa, Artificial Sequence
  Antimicrobial peptide sequence
GLLRILLRWLFRFGDGNGNGNGLARILLRLLFRFG

SEQ ID NO: 3703 - protein, 35 aa, Artificial Sequence
  Antimicrobial peptide sequence
GLLRILLRWLFRFGDGNGNGNGLVRILLRLLFRFG

SEQ ID NO: 3704 - protein, 35 aa, Artificial Sequence
  Antimicrobial peptide sequence
GLLRILLRWLFRFGDGNGNGNSLVRILLRLLLRFG

SEQ ID NO: 3705 - protein, 35 aa, Artificial Sequence
  Antimicrobial peptide sequence
GLLRILLRWLFRFGDGNGNGNGLVRILLRLLLRYG

SEQ ID NO: 3706 - protein, 35 aa, Artificial Sequence
  Antimicrobial peptide sequence
GLLRILLRWLFRFGDGNGNGNGLAWILLRWLFFRG

SEQ ID NO: 3707 - protein, 35 aa, Artificial Sequence
  Antimicrobial peptide sequence
GLLRILLRWLFRFGDGNGNGNGLVRILLRWLFFRG

SEQ ID NO: 3708 - protein, 35 aa, Artificial Sequence
  Antimicrobial peptide sequence
GLLRILLRWLFRFGDGNGNGNGLLRILLRWLFFRG

SEQ ID NO: 3709 - protein, 35 aa, Artificial Sequence
  Antimicrobial peptide sequence
GLLRILLRWLFRFGDGNGNGNGLPWILLRWLFRFG

SEQ ID NO: 3710 - protein, 35 aa, Artificial Sequence
  Antimicrobial peptide sequence
GLLRILLRWLFRFGDGNGNGNGLLRILLRWLFRFG

SEQ ID NO: 3711 - protein, 35 aa, Artificial Sequence
  Antimicrobial peptide sequence
GLLRILLRWLFRFGDGNGNGNGLPWILLRWLFRRG

SEQ ID NO: 3712 - protein, 35 aa, Artificial Sequence
  Antimicrobial peptide sequence
GLLRILLRWLFRFGDSGSGSGGLPWILLRWLFFRG

SEQ ID NO: 3713 - protein, 35 aa, Artificial Sequence
  Antimicrobial peptide sequence
GLLRILLRWLFRFGDSGSGSGGLARILLRWLFFRG

SEQ ID NO: 3714 - protein, 35 aa, Artificial Sequence
  Antimicrobial peptide sequence
GLLRILLRWLFRFGDSGSGSGGLARILLRWLFRFG

SEQ ID NO: 3715 - protein, 35 aa, Artificial Sequence
  Antimicrobial peptide sequence
GLLRILLRWLFRFGDSGSGSGGLVRILLRWLFRFG

SEQ ID NO: 3716 - protein, 35 aa, Artificial Sequence
  Antimicrobial peptide sequence
GLLRILLRWLFRFGDSGSGSGGLARILLRLLFFRG

SEQ ID NO: 3717 - protein, 35 aa, Artificial Sequence
  Antimicrobial peptide sequence
GLLRILLRWLFRFGDSGSGSGGLARILLRLLFRFG

SEQ ID NO: 3718 - protein, 35 aa, Artificial Sequence
  Antimicrobial peptide sequence
GLLRILLRWLFRFGDSGSGSGGLVRILLRLLFRFG

SEQ ID NO: 3719 - protein, 35 aa, Artificial Sequence
  Antimicrobial peptide sequence
GLLRILLRWLFRFGDSGSGSGSLVRILLRLLLRFG

SEQ ID NO: 3720 - protein, 35 aa, Artificial Sequence
  Antimicrobial peptide sequence
GLLRILLRWLFRFGDSGSGSGGLVRILLRLLLRYG

SEQ ID NO: 3721 - protein, 35 aa, Artificial Sequence
  Antimicrobial peptide sequence
GLLRILLRWLFRFGDSGSGSGGLAWILLRWLFFRG

SEQ ID NO: 3722 - protein, 35 aa, Artificial Sequence
  Antimicrobial peptide sequence
GLLRILLRWLFRFGDSGSGSGGLVRILLRWLFFRG

SEQ ID NO: 3723 - protein, 35 aa, Artificial Sequence
  Antimicrobial peptide sequence
GLLRILLRWLFRFGDSGSGSGGLLRILLRWLFFRG

SEQ ID NO: 3724 - protein, 35 aa, Artificial Sequence
  Antimicrobial peptide sequence
GLLRILLRWLFRFGDSGSGSGGLPWILLRWLFRFG

SEQ ID NO: 3725 - protein, 35 aa, Artificial Sequence
  Antimicrobial peptide sequence
GLLRILLRWLFRFGDSGSGSGGLLRILLRWLFRFG

SEQ ID NO: 3726 - protein, 35 aa, Artificial Sequence
  Antimicrobial peptide sequence
GLLRILLRWLFRFGDSGSGSGGLPWILLRWLFRRG

SEQ ID NO: 3727 - protein, 35 aa, Artificial Sequence
  Antimicrobial peptide sequence
GLLRILLRWLFRFGDGSGSGSGLPWILLRWLFFRG

SEQ ID NO: 3728 - protein, 35 aa, Artificial Sequence
  Antimicrobial peptide sequence
GLLRILLRWLFRFGDGSGSGSGLARILLRWLFFRG

SEQ ID NO: 3729 - protein, 35 aa, Artificial Sequence
  Antimicrobial peptide sequence
GLLRILLRWLFRFGDGSGSGSGLARILLRWLFRFG

SEQ ID NO: 3730 - protein, 35 aa, Artificial Sequence
  Antimicrobial peptide sequence
GLLRILLRWLFRFGDGSGSGSGLVRILLRWLFRFG

SEQ ID NO: 3731 - protein, 35 aa, Artificial Sequence
  Antimicrobial peptide sequence
GLLRILLRWLFRFGDGSGSGSGLARILLRLLFFRG

SEQ ID NO: 3732 - protein, 35 aa, Artificial Sequence
  Antimicrobial peptide sequence
GLLRILLRWLFRFGDGSGSGSGLARILLRLLFRFG

SEQ ID NO: 3733 - protein, 35 aa, Artificial Sequence
  Antimicrobial peptide sequence
GLLRILLRWLFRFGDGSGSGSGLVRILLRLLFRFG

SEQ ID NO: 3734 - protein, 35 aa, Artificial Sequence
  Antimicrobial peptide sequence
GLLRILLRWLFRFGDGSGSGSSLVRILLRLLLRFG

SEQ ID NO: 3735 - protein, 35 aa, Artificial Sequence
  Antimicrobial peptide sequence
GLLRILLRWLFRFGDGSGSGSGLVRILLRLLLRYG

SEQ ID NO: 3736 - protein, 35 aa, Artificial Sequence
  Antimicrobial peptide sequence
GLLRILLRWLFRFGDGSGSGSGLAWILLRWLFFRG

SEQ ID NO: 3737 - protein, 35 aa, Artificial Sequence
  Antimicrobial peptide sequence
GLLRILLRWLFRFGDGSGSGSGLVRILLRWLFFRG

SEQ ID NO: 3738 - protein, 35 aa, Artificial Sequence
  Antimicrobial peptide sequence
GLLRILLRWLFRFGDGSGSGSGLLRILLRWLFFRG

SEQ ID NO: 3739 - protein, 35 aa, Artificial Sequence
  Antimicrobial peptide sequence
GLLRILLRWLFRFGDGSGSGSGLPWILLRWLFRFG

SEQ ID NO: 3740 - protein, 35 aa, Artificial Sequence
  Antimicrobial peptide sequence
GLLRILLRWLFRFGDGSGSGSGLLRILLRWLFRFG

SEQ ID NO: 3741 - protein, 35 aa, Artificial Sequence
  Antimicrobial peptide sequence
GLLRILLRWLFRFGDGSGSGSGLPWILLRWLFRRG

SEQ ID NO: 3742 - protein, 35 aa, Artificial Sequence
  Antimicrobial peptide sequence
GLLRILLRWLFRFGDSNSNSNGLPWILLRWLFFRG

SEQ ID NO: 3743 - protein, 35 aa, Artificial Sequence
  Antimicrobial peptide sequence
GLLRILLRWLFRFGDSNSNSNGLARILLRWLFFRG

SEQ ID NO: 3744 - protein, 35 aa, Artificial Sequence
  Antimicrobial peptide sequence
GLLRILLRWLFRFGDSNSNSNGLARILLRWLFRFG

SEQ ID NO: 3745 - protein, 35 aa, Artificial Sequence
  Antimicrobial peptide sequence
GLLRILLRWLFRFGDSNSNSNGLVRILLRWLFRFG

SEQ ID NO: 3746 - protein, 35 aa, Artificial Sequence
  Antimicrobial peptide sequence
GLLRILLRWLFRFGDSNSNSNGLARILLRLLFFRG

SEQ ID NO: 3747 - protein, 35 aa, Artificial Sequence
  Antimicrobial peptide sequence
GLLRILLRWLFRFGDSNSNSNGLARILLRLLFRFG

SEQ ID NO: 3748 - protein, 35 aa, Artificial Sequence
  Antimicrobial peptide sequence
GLLRILLRWLFRFGDSNSNSNGLVRILLRLLFRFG

SEQ ID NO: 3749 - protein, 35 aa, Artificial Sequence
  Antimicrobial peptide sequence
GLLRILLRWLFRFGDSNSNSNSLVRILLRLLLRFG

SEQ ID NO: 3750 - protein, 35 aa, Artificial Sequence
  Antimicrobial peptide sequence
GLLRILLRWLFRFGDSNSNSNGLVRILLRLLLRYG

SEQ ID NO: 3751 - protein, 35 aa, Artificial Sequence
  Antimicrobial peptide sequence
GLLRILLRWLFRFGDSNSNSNGLAWILLRWLFFRG

SEQ ID NO: 3752 - protein, 35 aa, Artificial Sequence
  Antimicrobial peptide sequence
GLLRILLRWLFRFGDSNSNSNGLVRILLRWLFFRG

SEQ ID NO: 3753 - protein, 35 aa, Artificial Sequence
  Antimicrobial peptide sequence
GLLRILLRWLFRFGDSNSNSNGLLRILLRWLFFRG

SEQ ID NO: 3754 - protein, 35 aa, Artificial Sequence
  Antimicrobial peptide sequence
GLLRILLRWLFRFGDSNSNSNGLPWILLRWLFRFG

SEQ ID NO: 3755 - protein, 35 aa, Artificial Sequence
  Antimicrobial peptide sequence
GLLRILLRWLFRFGDSNSNSNGLLRILLRWLFRFG

SEQ ID NO: 3756 - protein, 35 aa, Artificial Sequence
  Antimicrobial peptide sequence
GLLRILLRWLFRFGDSNSNSNGLPWILLRWLFRRG

SEQ ID NO: 3757 - protein, 35 aa, Artificial Sequence
  Antimicrobial peptide sequence
GLLRILLRWLFRFGDNSNSNSGLPWILLRWLFFRG

SEQ ID NO: 3758 - protein, 35 aa, Artificial Sequence
  Antimicrobial peptide sequence
GLLRILLRWLFRFGDNSNSNSGLARILLRWLFFRG

SEQ ID NO: 3759 - protein, 35 aa, Artificial Sequence
  Antimicrobial peptide sequence
GLLRILLRWLFRFGDNSNSNSGLARILLRWLFRFG

SEQ ID NO: 3760 - protein, 35 aa, Artificial Sequence
  Antimicrobial peptide sequence
GLLRILLRWLFRFGDNSNSNSGLVRILLRWLFRFG

SEQ ID NO: 3761 - protein, 35 aa, Artificial Sequence
  Antimicrobial peptide sequence
GLLRILLRWLFRFGDNSNSNSGLARILLRLLFFRG

SEQ ID NO: 3762 - protein, 35 aa, Artificial Sequence
  Antimicrobial peptide sequence
GLLRILLRWLFRFGDNSNSNSGLARILLRLLFRFG

SEQ ID NO: 3763 - protein, 35 aa, Artificial Sequence
  Antimicrobial peptide sequence
GLLRILLRWLFRFGDNSNSNSGLVRILLRLLFRFG

SEQ ID NO: 3764 - protein, 35 aa, Artificial Sequence
  Antimicrobial peptide sequence
GLLRILLRWLFRFGDNSNSNSSLVRILLRLLLRFG

SEQ ID NO: 3765 - protein, 35 aa, Artificial Sequence
  Antimicrobial peptide sequence
GLLRILLRWLFRFGDNSNSNSGLVRILLRLLLRYG

SEQ ID NO: 3766 - protein, 35 aa, Artificial Sequence
  Antimicrobial peptide sequence
GLLRILLRWLFRFGDNSNSNSGLAWILLRWLFFRG

SEQ ID NO: 3767 - protein, 35 aa, Artificial Sequence
  Antimicrobial peptide sequence
GLLRILLRWLFRFGDNSNSNSGLVRILLRWLFFRG

SEQ ID NO: 3768 - protein, 35 aa, Artificial Sequence
  Antimicrobial peptide sequence
GLLRILLRWLFRFGDNSNSNSGLLRILLRWLFFRG

SEQ ID NO: 3769 - protein, 35 aa, Artificial Sequence
  Antimicrobial peptide sequence
GLLRILLRWLFRFGDNSNSNSGLPWILLRWLFRFG

SEQ ID NO: 3770 - protein, 35 aa, Artificial Sequence
  Antimicrobial peptide sequence
GLLRILLRWLFRFGDNSNSNSGLLRILLRWLFRFG

SEQ ID NO: 3771 - protein, 35 aa, Artificial Sequence
  Antimicrobial peptide sequence
GLLRILLRWLFRFGDNSNSNSGLPWILLRWLFRRG

SEQ ID NO: 3772 - protein, 35 aa, Artificial Sequence
  Antimicrobial peptide sequence
GLLRILLRWLFRFGDHGHGHGGLPWILLRWLFFRG

SEQ ID NO: 3773 - protein, 35 aa, Artificial Sequence
  Antimicrobial peptide sequence
GLLRILLRWLFRFGDHGHGHGGLARILLRWLFFRG

SEQ ID NO: 3774 - protein, 35 aa, Artificial Sequence
  Antimicrobial peptide sequence
GLLRILLRWLFRFGDHGHGHGGLARILLRWLFRFG

SEQ ID NO: 3775 - protein, 35 aa, Artificial Sequence
  Antimicrobial peptide sequence
GLLRILLRWLFRFGDHGHGHGGLVRILLRWLFRFG

SEQ ID NO: 3776 - protein, 35 aa, Artificial Sequence
  Antimicrobial peptide sequence
GLLRILLRWLFRFGDHGHGHGGLARILLRLLFFRG

SEQ ID NO: 3777 - protein, 35 aa, Artificial Sequence
  Antimicrobial peptide sequence
GLLRILLRWLFRFGDHGHGHGGLARILLRLLFRFG

SEQ ID NO: 3778 - protein, 35 aa, Artificial Sequence
  Antimicrobial peptide sequence
GLLRILLRWLFRFGDHGHGHGGLVRILLRLLFRFG

SEQ ID NO: 3779 - protein, 35 aa, Artificial Sequence
  Antimicrobial peptide sequence
GLLRILLRWLFRFGDHGHGHGSLVRILLRLLLRFG

SEQ ID NO: 3780 - protein, 35 aa, Artificial Sequence
  Antimicrobial peptide sequence
GLLRILLRWLFRFGDHGHGHGGLVRILLRLLLRYG

SEQ ID NO: 3781 - protein, 35 aa, Artificial Sequence
  Antimicrobial peptide sequence
GLLRILLRWLFRFGDHGHGHGGLAWILLRWLFFRG

SEQ ID NO: 3782 - protein, 35 aa, Artificial Sequence
  Antimicrobial peptide sequence
GLLRILLRWLFRFGDHGHGHGGLVRILLRWLFFRG

SEQ ID NO: 3783 - protein, 35 aa, Artificial Sequence
  Antimicrobial peptide sequence
GLLRILLRWLFRFGDHGHGHGGLLRILLRWLFFRG

SEQ ID NO: 3784 - protein, 35 aa, Artificial Sequence
  Antimicrobial peptide sequence
GLLRILLRWLFRFGDHGHGHGGLPWILLRWLFRFG

SEQ ID NO: 3785 - protein, 35 aa, Artificial Sequence
  Antimicrobial peptide sequence
GLLRILLRWLFRFGDHGHGHGGLLRILLRWLFRFG

SEQ ID NO: 3786 - protein, 35 aa, Artificial Sequence
  Antimicrobial peptide sequence
GLLRILLRWLFRFGDHGHGHGGLPWILLRWLFRRG

SEQ ID NO: 3787 - protein, 35 aa, Artificial Sequence
  Antimicrobial peptide sequence
GLLRILLRWLFRFGDGHGHGHGLPWILLRWLFFRG

SEQ ID NO: 3788 - protein, 35 aa, Artificial Sequence
  Antimicrobial peptide sequence
GLLRILLRWLFRFGDGHGHGHGLARILLRWLFFRG

SEQ ID NO: 3789 - protein, 35 aa, Artificial Sequence
  Antimicrobial peptide sequence
GLLRILLRWLFRFGDGHGHGHGLARILLRWLFRFG

SEQ ID NO: 3790 - protein, 35 aa, Artificial Sequence
  Antimicrobial peptide sequence
GLLRILLRWLFRFGDGHGHGHGLVRILLRWLFRFG

SEQ ID NO: 3791 - protein, 35 aa, Artificial Sequence
  Antimicrobial peptide sequence
GLLRILLRWLFRFGDGHGHGHGLARILLRLLFFRG

SEQ ID NO: 3792 - protein, 35 aa, Artificial Sequence
  Antimicrobial peptide sequence
GLLRILLRWLFRFGDGHGHGHGLARILLRLLFRFG

SEQ ID NO: 3793 - protein, 35 aa, Artificial Sequence
  Antimicrobial peptide sequence
GLLRILLRWLFRFGDGHGHGHGLVRILLRLLFRFG

SEQ ID NO: 3794 - protein, 35 aa, Artificial Sequence
  Antimicrobial peptide sequence
GLLRILLRWLFRFGDGHGHGHSLVRILLRLLLRFG

SEQ ID NO: 3795 - protein, 35 aa, Artificial Sequence
  Antimicrobial peptide sequence
GLLRILLRWLFRFGDGHGHGHGLVRILLRLLLRYG

SEQ ID NO: 3796 - protein, 35 aa, Artificial Sequence
  Antimicrobial peptide sequence
GLLRILLRWLFRFGDGHGHGHGLAWILLRWLFFRG

SEQ ID NO: 3797 - protein, 35 aa, Artificial Sequence
  Antimicrobial peptide sequence
GLLRILLRWLFRFGDGHGHGHGLVRILLRWLFFRG

SEQ ID NO: 3798 - protein, 35 aa, Artificial Sequence
  Antimicrobial peptide sequence
GLLRILLRWLFRFGDGHGHGHGLLRILLRWLFFRG

SEQ ID NO: 3799 - protein, 35 aa, Artificial Sequence
  Antimicrobial peptide sequence
GLLRILLRWLFRFGDGHGHGHGLPWILLRWLFRFG

SEQ ID NO: 3800 - protein, 35 aa, Artificial Sequence
  Antimicrobial peptide sequence
GLLRILLRWLFRFGDGHGHGHGLLRILLRWLFRFG

SEQ ID NO: 3801 - protein, 35 aa, Artificial Sequence
  Antimicrobial peptide sequence
GLLRILLRWLFRFGDGHGHGHGLPWILLRWLFRRG

SEQ ID NO: 3802 - protein, 35 aa, Artificial Sequence
  Antimicrobial peptide sequence
GLLRILLRWLFRFGDHNHNHNGLPWILLRWLFFRG

SEQ ID NO: 3803 - protein, 35 aa, Artificial Sequence
  Antimicrobial peptide sequence
GLLRILLRWLFRFGDHNHNHNGLARILLRWLFFRG

SEQ ID NO: 3804 - protein, 35 aa, Artificial Sequence
  Antimicrobial peptide sequence
GLLRILLRWLFRFGDHNHNHNGLARILLRWLFRFG

SEQ ID NO: 3805 - protein, 35 aa, Artificial Sequence
  Antimicrobial peptide sequence
GLLRILLRWLFRFGDHNHNHNGLVRILLRWLFRFG

SEQ ID NO: 3806 - protein, 35 aa, Artificial Sequence
  Antimicrobial peptide sequence
GLLRILLRWLFRFGDHNHNHNGLARILLRLLFFRG

SEQ ID NO: 3807 - protein, 35 aa, Artificial Sequence
  Antimicrobial peptide sequence
GLLRILLRWLFRFGDHNHNHNGLARILLRLLFRFG

SEQ ID NO: 3808 - protein, 35 aa, Artificial Sequence
  Antimicrobial peptide sequence
GLLRILLRWLFRFGDHNHNHNGLVRILLRLLFRFG

SEQ ID NO: 3809 - protein, 35 aa, Artificial Sequence
  Antimicrobial peptide sequence
GLLRILLRWLFRFGDHNHNHNSLVRILLRLLLRFG

SEQ ID NO: 3810 - protein, 35 aa, Artificial Sequence
  Antimicrobial peptide sequence
GLLRILLRWLFRFGDHNHNHNGLVRILLRLLLRYG

SEQ ID NO: 3811 - protein, 35 aa, Artificial Sequence
  Antimicrobial peptide sequence
GLLRILLRWLFRFGDHNHNHNGLAWILLRWLFFRG

SEQ ID NO: 3812 - protein, 35 aa, Artificial Sequence
  Antimicrobial peptide sequence
GLLRILLRWLFRFGDHNHNHNGLVRILLRWLFFRG

SEQ ID NO: 3813 - protein, 35 aa, Artificial Sequence
  Antimicrobial peptide sequence
GLLRILLRWLFRFGDHNHNHNGLLRILLRWLFFRG

SEQ ID NO: 3814 - protein, 35 aa, Artificial Sequence
  Antimicrobial peptide sequence
GLLRILLRWLFRFGDHNHNHNGLPWILLRWLFRFG

SEQ ID NO: 3815 - protein, 35 aa, Artificial Sequence
  Antimicrobial peptide sequence
GLLRILLRWLFRFGDHNHNHNGLLRILLRWLFRFG

SEQ ID NO: 3816 - protein, 35 aa, Artificial Sequence
  Antimicrobial peptide sequence
GLLRILLRWLFRFGDHNHNHNGLPWILLRWLFRRG

SEQ ID NO: 3817 - protein, 35 aa, Artificial Sequence
  Antimicrobial peptide sequence
GLLRILLRWLFRFGDNHNHNHGLPWILLRWLFFRG

SEQ ID NO: 3818 - protein, 35 aa, Artificial Sequence
  Antimicrobial peptide sequence
GLLRILLRWLFRFGDNHNHNHGLARILLRWLFFRG

SEQ ID NO: 3819 - protein, 35 aa, Artificial Sequence
  Antimicrobial peptide sequence
GLLRILLRWLFRFGDNHNHNHGLARILLRWLFRFG

SEQ ID NO: 3820 - protein, 35 aa, Artificial Sequence
  Antimicrobial peptide sequence
GLLRILLRWLFRFGDNHNHNHGLVRILLRWLFRFG

SEQ ID NO: 3821 - protein, 35 aa, Artificial Sequence
  Antimicrobial peptide sequence
GLLRILLRWLFRFGDNHNHNHGLARILLRLLFFRG

SEQ ID NO: 3822 - protein, 35 aa, Artificial Sequence
  Antimicrobial peptide sequence
GLLRILLRWLFRFGDNHNHNHGLARILLRLLFRFG

SEQ ID NO: 3823 - protein, 35 aa, Artificial Sequence
  Antimicrobial peptide sequence
GLLRILLRWLFRFGDNHNHNHGLVRILLRLLFRFG

SEQ ID NO: 3824 - protein, 35 aa, Artificial Sequence
  Antimicrobial peptide sequence
GLLRILLRWLFRFGDNHNHNHSLVRILLRLLLRFG

SEQ ID NO: 3825 - protein, 35 aa, Artificial Sequence
  Antimicrobial peptide sequence
GLLRILLRWLFRFGDNHNHNHGLVRILLRLLLRYG

SEQ ID NO: 3826 - protein, 35 aa, Artificial Sequence
  Antimicrobial peptide sequence
GLLRILLRWLFRFGDNHNHNHGLAWILLRWLFFRG

SEQ ID NO: 3827 - protein, 35 aa, Artificial Sequence
  Antimicrobial peptide sequence
GLLRILLRWLFRFGDNHNHNHGLVRILLRWLFFRG

SEQ ID NO: 3828 - protein, 35 aa, Artificial Sequence
  Antimicrobial peptide sequence
GLLRILLRWLFRFGDNHNHNHGLLRILLRWLFFRG

SEQ ID NO: 3829 - protein, 35 aa, Artificial Sequence
  Antimicrobial peptide sequence
GLLRILLRWLFRFGDNHNHNHGLPWILLRWLFRFG

SEQ ID NO: 3830 - protein, 35 aa, Artificial Sequence
  Antimicrobial peptide sequence
GLLRILLRWLFRFGDNHNHNHGLLRILLRWLFRFG

SEQ ID NO: 3831 - protein, 35 aa, Artificial Sequence
  Antimicrobial peptide sequence
GLLRILLRWLFRFGDNHNHNHGLPWILLRWLFRRG

SEQ ID NO: 3832 - protein, 33 aa, Artificial Sequence
  Antimicrobial peptide sequence
GLPWILLRWLFRRGDGGGGGLPWILLRWLFFRG

SEQ ID NO: 3833 - protein, 33 aa, Artificial Sequence
  Antimicrobial peptide sequence
GLPWILLRWLFRRGDGGGGGLARILLRWLFFRG

SEQ ID NO: 3834 - protein, 33 aa, Artificial Sequence
  Antimicrobial peptide sequence
GLPWILLRWLFRRGDGGGGGLARILLRWLFRFG

SEQ ID NO: 3835 - protein, 33 aa, Artificial Sequence
  Antimicrobial peptide sequence
GLPWILLRWLFRRGDGGGGGLVRILLRWLFRFG

SEQ ID NO: 3836 - protein, 33 aa, Artificial Sequence
  Antimicrobial peptide sequence
GLPWILLRWLFRRGDGGGGGLARILLRLLFFRG

SEQ ID NO: 3837 - protein, 33 aa, Artificial Sequence
  Antimicrobial peptide sequence
GLPWILLRWLFRRGDGGGGGLARILLRLLFRFG

SEQ ID NO: 3838 - protein, 33 aa, Artificial Sequence
  Antimicrobial peptide sequence
GLPWILLRWLFRRGDGGGGGLVRILLRLLFRFG

SEQ ID NO: 3839 - protein, 33 aa, Artificial Sequence
  Antimicrobial peptide sequence
GLPWILLRWLFRRGDGGGGSLVRILLRLLLRFG

SEQ ID NO: 3840 - protein, 33 aa, Artificial Sequence
  Antimicrobial peptide sequence
GLPWILLRWLFRRGDGGGGGLVRILLRLLLRYG

SEQ ID NO: 3841 - protein, 33 aa, Artificial Sequence
  Antimicrobial peptide sequence
GLPWILLRWLFRRGDGGGGGLAWILLRWLFFRG

SEQ ID NO: 3842 - protein, 33 aa, Artificial Sequence
  Antimicrobial peptide sequence
GLPWILLRWLFRRGDGGGGGLVRILLRWLFFRG

SEQ ID NO: 3843 - protein, 33 aa, Artificial Sequence
  Antimicrobial peptide sequence
GLPWILLRWLFRRGDGGGGGLLRILLRWLFFRG

SEQ ID NO: 3844 - protein, 33 aa, Artificial Sequence
  Antimicrobial peptide sequence
GLPWILLRWLFRRGDGGGGGLPWILLRWLFRFG

SEQ ID NO: 3845 - protein, 33 aa, Artificial Sequence
  Antimicrobial peptide sequence
GLPWILLRWLFRRGDGGGGGLLRILLRWLFRFG

SEQ ID NO: 3846 - protein, 33 aa, Artificial Sequence
  Antimicrobial peptide sequence
GLPWILLRWLFRRGDGGGGGLPWILLRWLFRRG

SEQ ID NO: 3847 - protein, 34 aa, Artificial Sequence
  Antimicrobial peptide sequence
GLPWILLRWLFRRGDGGGGGGLPWILLRWLFFRG

SEQ ID NO: 3848 - protein, 34 aa, Artificial Sequence
  Antimicrobial peptide sequence
GLPWILLRWLFRRGDGGGGGGLARILLRWLFFRG

SEQ ID NO: 3849 - protein, 34 aa, Artificial Sequence
  Antimicrobial peptide sequence
GLPWILLRWLFRRGDGGGGGGLARILLRWLFRFG

SEQ ID NO: 3850 - protein, 34 aa, Artificial Sequence
  Antimicrobial peptide sequence
GLPWILLRWLFRRGDGGGGGGLVRILLRWLFRFG

SEQ ID NO: 3851 - protein, 34 aa, Artificial Sequence
  Antimicrobial peptide sequence
GLPWILLRWLFRRGDGGGGGGLARILLRLLFFRG

SEQ ID NO: 3852 - protein, 34 aa, Artificial Sequence
  Antimicrobial peptide sequence
GLPWILLRWLFRRGDGGGGGGLARILLRLLFRFG

SEQ ID NO: 3853 - protein, 34 aa, Artificial Sequence
  Antimicrobial peptide sequence
GLPWILLRWLFRRGDGGGGGGLVRILLRLLFRFG

SEQ ID NO: 3854 - protein, 34 aa, Artificial Sequence
  Antimicrobial peptide sequence
GLPWILLRWLFRRGDGGGGGSLVRILLRLLLRFG

SEQ ID NO: 3855 - protein, 34 aa, Artificial Sequence
  Antimicrobial peptide sequence
GLPWILLRWLFRRGDGGGGGGLVRILLRLLLRYG

SEQ ID NO: 3856 - protein, 34 aa, Artificial Sequence
  Antimicrobial peptide sequence
GLPWILLRWLFRRGDGGGGGGLAWILLRWLFFRG

SEQ ID NO: 3857 - protein, 34 aa, Artificial Sequence
  Antimicrobial peptide sequence
GLPWILLRWLFRRGDGGGGGGLVRILLRWLFFRG

SEQ ID NO: 3858 - protein, 34 aa, Artificial Sequence
  Antimicrobial peptide sequence
GLPWILLRWLFRRGDGGGGGGLLRILLRWLFFRG

SEQ ID NO: 3859 - protein, 34 aa, Artificial Sequence
  Antimicrobial peptide sequence
GLPWILLRWLFRRGDGGGGGGLPWILLRWLFRFG

SEQ ID NO: 3860 - protein, 34 aa, Artificial Sequence
  Antimicrobial peptide sequence
GLPWILLRWLFRRGDGGGGGGLLRILLRWLFRFG

SEQ ID NO: 3861 - protein, 34 aa, Artificial Sequence
  Antimicrobial peptide sequence
GLPWILLRWLFRRGDGGGGGGLPWILLRWLFRRG

SEQ ID NO: 3862 - protein, 35 aa, Artificial Sequence
  Antimicrobial peptide sequence
GLPWILLRWLFRRGDGGGGGGGLPWILLRWLFFRG

SEQ ID NO: 3863 - protein, 35 aa, Artificial Sequence
  Antimicrobial peptide sequence
GLPWILLRWLFRRGDGGGGGGGLARILLRWLFFRG

SEQ ID NO: 3864 - protein, 35 aa, Artificial Sequence
  Antimicrobial peptide sequence
GLPWILLRWLFRRGDGGGGGGGLARILLRWLFRFG

SEQ ID NO: 3865 - protein, 35 aa, Artificial Sequence
  Antimicrobial peptide sequence
GLPWILLRWLFRRGDGGGGGGGLVRILLRWLFRFG

SEQ ID NO: 3866 - protein, 35 aa, Artificial Sequence
  Antimicrobial peptide sequence
GLPWILLRWLFRRGDGGGGGGGLARILLRLLFFRG

SEQ ID NO: 3867 - protein, 35 aa, Artificial Sequence
  Antimicrobial peptide sequence
GLPWILLRWLFRRGDGGGGGGGLARILLRLLFRFG

SEQ ID NO: 3868 - protein, 35 aa, Artificial Sequence
  Antimicrobial peptide sequence
GLPWILLRWLFRRGDGGGGGGGLVRILLRLLFRFG

SEQ ID NO: 3869 - protein, 35 aa, Artificial Sequence
  Antimicrobial peptide sequence
GLPWILLRWLFRRGDGGGGGGSLVRILLRLLLRFG

SEQ ID NO: 3870 - protein, 35 aa, Artificial Sequence
  Antimicrobial peptide sequence
GLPWILLRWLFRRGDGGGGGGGLVRILLRLLLRYG

SEQ ID NO: 3871 - protein, 35 aa, Artificial Sequence
  Antimicrobial peptide sequence
GLPWILLRWLFRRGDGGGGGGGLAWILLRWLFFRG

SEQ ID NO: 3872 - protein, 35 aa, Artificial Sequence
  Antimicrobial peptide sequence
GLPWILLRWLFRRGDGGGGGGGLVRILLRWLFFRG

SEQ ID NO: 3873 - protein, 35 aa, Artificial Sequence
  Antimicrobial peptide sequence
GLPWILLRWLFRRGDGGGGGGGLLRILLRWLFFRG

SEQ ID NO: 3874 - protein, 35 aa, Artificial Sequence
  Antimicrobial peptide sequence
GLPWILLRWLFRRGDGGGGGGGLPWILLRWLFRFG

SEQ ID NO: 3875 - protein, 35 aa, Artificial Sequence
  Antimicrobial peptide sequence
GLPWILLRWLFRRGDGGGGGGGLLRILLRWLFRFG

SEQ ID NO: 3876 - protein, 35 aa, Artificial Sequence
  Antimicrobial peptide sequence
GLPWILLRWLFRRGDGGGGGGGLPWILLRWLFRRG

SEQ ID NO: 3877 - protein, 36 aa, Artificial Sequence
  Antimicrobial peptide sequence
GLPWILLRWLFRRGDGGGGGGGGLPWILLRWLFFRG

SEQ ID NO: 3878 - protein, 36 aa, Artificial Sequence
  Antimicrobial peptide sequence
GLPWILLRWLFRRGDGGGGGGGGLARILLRWLFFRG

SEQ ID NO: 3879 - protein, 36 aa, Artificial Sequence
  Antimicrobial peptide sequence
GLPWILLRWLFRRGDGGGGGGGGLARILLRWLFRFG

SEQ ID NO: 3880 - protein, 36 aa, Artificial Sequence
  Antimicrobial peptide sequence
GLPWILLRWLFRRGDGGGGGGGGLVRILLRWLFRFG

SEQ ID NO: 3881 - protein, 36 aa, Artificial Sequence
  Antimicrobial peptide sequence
GLPWILLRWLFRRGDGGGGGGGGLARILLRLLFFRG

SEQ ID NO: 3882 - protein, 36 aa, Artificial Sequence
  Antimicrobial peptide sequence
GLPWILLRWLFRRGDGGGGGGGGLARILLRLLFRFG

SEQ ID NO: 3883 - protein, 36 aa, Artificial Sequence
  Antimicrobial peptide sequence
GLPWILLRWLFRRGDGGGGGGGGLVRILLRLLFRFG

SEQ ID NO: 3884 - protein, 36 aa, Artificial Sequence
  Antimicrobial peptide sequence
GLPWILLRWLFRRGDGGGGGGGSLVRILLRLLLRFG

SEQ ID NO: 3885 - protein, 36 aa, Artificial Sequence
  Antimicrobial peptide sequence
GLPWILLRWLFRRGDGGGGGGGGLVRILLRLLLRYG

SEQ ID NO: 3886 - protein, 36 aa, Artificial Sequence
  Antimicrobial peptide sequence
GLPWILLRWLFRRGDGGGGGGGGLAWILLRWLFFRG

SEQ ID NO: 3887 - protein, 36 aa, Artificial Sequence
  Antimicrobial peptide sequence
GLPWILLRWLFRRGDGGGGGGGGLVRILLRWLFFRG

SEQ ID NO: 3888 - protein, 36 aa, Artificial Sequence
  Antimicrobial peptide sequence
GLPWILLRWLFRRGDGGGGGGGGLLRILLRWLFFRG

SEQ ID NO: 3889 - protein, 36 aa, Artificial Sequence
  Antimicrobial peptide sequence
GLPWILLRWLFRRGDGGGGGGGGLPWILLRWLFRFG

SEQ ID NO: 3890 - protein, 36 aa, Artificial Sequence
  Antimicrobial peptide sequence
GLPWILLRWLFRRGDGGGGGGGGLLRILLRWLFRFG

SEQ ID NO: 3891 - protein, 36 aa, Artificial Sequence
  Antimicrobial peptide sequence
GLPWILLRWLFRRGDGGGGGGGGLPWILLRWLFRRG

SEQ ID NO: 3892 - protein, 33 aa, Artificial Sequence
  Antimicrobial peptide sequence
GLPWILLRWLFRRGDNNNNGLPWILLRWLFFRG

SEQ ID NO: 3893 - protein, 33 aa, Artificial Sequence
  Antimicrobial peptide sequence
GLPWILLRWLFRRGDNNNNGLARILLRWLFFRG

SEQ ID NO: 3894 - protein, 33 aa, Artificial Sequence
  Antimicrobial peptide sequence
GLPWILLRWLFRRGDNNNNGLARILLRWLFRFG

SEQ ID NO: 3895 - protein, 33 aa, Artificial Sequence
  Antimicrobial peptide sequence
GLPWILLRWLFRRGDNNNNGLVRILLRWLFRFG

SEQ ID NO: 3896 - protein, 33 aa, Artificial Sequence
  Antimicrobial peptide sequence
GLPWILLRWLFRRGDNNNNGLARILLRLLFFRG

SEQ ID NO: 3897 - protein, 33 aa, Artificial Sequence
  Antimicrobial peptide sequence
GLPWILLRWLFRRGDNNNNGLARILLRLLFRFG

SEQ ID NO: 3898 - protein, 33 aa, Artificial Sequence
  Antimicrobial peptide sequence
GLPWILLRWLFRRGDNNNNGLVRILLRLLFRFG

SEQ ID NO: 3899 - protein, 33 aa, Artificial Sequence
  Antimicrobial peptide sequence
GLPWILLRWLFRRGDNNNNSLVRILLRLLLRFG

SEQ ID NO: 3900 - protein, 33 aa, Artificial Sequence
  Antimicrobial peptide sequence
GLPWILLRWLFRRGDNNNNGLVRILLRLLLRYG

SEQ ID NO: 3901 - protein, 33 aa, Artificial Sequence
  Antimicrobial peptide sequence
GLPWILLRWLFRRGDNNNNGLAWILLRWLFFRG

SEQ ID NO: 3902 - protein, 33 aa, Artificial Sequence
  Antimicrobial peptide sequence
GLPWILLRWLFRRGDNNNNGLVRILLRWLFFRG

SEQ ID NO: 3903 - protein, 33 aa, Artificial Sequence
  Antimicrobial peptide sequence
GLPWILLRWLFRRGDNNNNGLLRILLRWLFFRG

SEQ ID NO: 3904 - protein, 33 aa, Artificial Sequence
  Antimicrobial peptide sequence
GLPWILLRWLFRRGDNNNNGLPWILLRWLFRFG

SEQ ID NO: 3905 - protein, 33 aa, Artificial Sequence
  Antimicrobial peptide sequence
GLPWILLRWLFRRGDNNNNGLLRILLRWLFRFG

SEQ ID NO: 3906 - protein, 33 aa, Artificial Sequence
  Antimicrobial peptide sequence
GLPWILLRWLFRRGDNNNNGLPWILLRWLFRRG

SEQ ID NO: 3907 - protein, 34 aa, Artificial Sequence
  Antimicrobial peptide sequence
GLPWILLRWLFRRGDNNNNNGLPWILLRWLFFRG

SEQ ID NO: 3908 - protein, 34 aa, Artificial Sequence
  Antimicrobial peptide sequence
GLPWILLRWLFRRGDNNNNNGLARILLRWLFFRG

SEQ ID NO: 3909 - protein, 34 aa, Artificial Sequence
  Antimicrobial peptide sequence
GLPWILLRWLFRRGDNNNNNGLARILLRWLFRFG

SEQ ID NO: 3910 - protein, 34 aa, Artificial Sequence
  Antimicrobial peptide sequence
GLPWILLRWLFRRGDNNNNNGLVRILLRWLFRFG

SEQ ID NO: 3911 - protein, 34 aa, Artificial Sequence
  Antimicrobial peptide sequence
GLPWILLRWLFRRGDNNNNNGLARILLRLLFFRG

SEQ ID NO: 3912 - protein, 34 aa, Artificial Sequence
  Antimicrobial peptide sequence
GLPWILLRWLFRRGDNNNNNGLARILLRLLFRFG

SEQ ID NO: 3913 - protein, 34 aa, Artificial Sequence
  Antimicrobial peptide sequence
GLPWILLRWLFRRGDNNNNNGLVRILLRLLFRFG

SEQ ID NO: 3914 - protein, 34 aa, Artificial Sequence
  Antimicrobial peptide sequence
GLPWILLRWLFRRGDNNNNNSLVRILLRLLLRFG

SEQ ID NO: 3915 - protein, 34 aa, Artificial Sequence
  Antimicrobial peptide sequence
GLPWILLRWLFRRGDNNNNNGLVRILLRLLLRYG

SEQ ID NO: 3916 - protein, 34 aa, Artificial Sequence
  Antimicrobial peptide sequence
GLPWILLRWLFRRGDNNNNNGLAWILLRWLFFRG

SEQ ID NO: 3917 - protein, 34 aa, Artificial Sequence
  Antimicrobial peptide sequence
GLPWILLRWLFRRGDNNNNNGLVRILLRWLFFRG

SEQ ID NO: 3918 - protein, 34 aa, Artificial Sequence
  Antimicrobial peptide sequence
GLPWILLRWLFRRGDNNNNNGLLRILLRWLFFRG

SEQ ID NO: 3919 - protein, 34 aa, Artificial Sequence
  Antimicrobial peptide sequence
GLPWILLRWLFRRGDNNNNNGLPWILLRWLFRFG

SEQ ID NO: 3920 - protein, 34 aa, Artificial Sequence
  Antimicrobial peptide sequence
GLPWILLRWLFRRGDNNNNNGLLRILLRWLFRFG

SEQ ID NO: 3921 - protein, 34 aa, Artificial Sequence
  Antimicrobial peptide sequence
GLPWILLRWLFRRGDNNNNNGLPWILLRWLFRRG

SEQ ID NO: 3922 - protein, 35 aa, Artificial Sequence
  Antimicrobial peptide sequence
GLPWILLRWLFRRGDNNNNNNGLPWILLRWLFFRG

SEQ ID NO: 3923 - protein, 35 aa, Artificial Sequence
  Antimicrobial peptide sequence
GLPWILLRWLFRRGDNNNNNNGLARILLRWLFFRG

SEQ ID NO: 3924 - protein, 35 aa, Artificial Sequence
  Antimicrobial peptide sequence
GLPWILLRWLFRRGDNNNNNNGLARILLRWLFRFG

SEQ ID NO: 3925 - protein, 35 aa, Artificial Sequence
  Antimicrobial peptide sequence
GLPWILLRWLFRRGDNNNNNNGLVRILLRWLFRFG

SEQ ID NO: 3926 - protein, 35 aa, Artificial Sequence
  Antimicrobial peptide sequence
GLPWILLRWLFRRGDNNNNNNGLARILLRLLFFRG

SEQ ID NO: 3927 - protein, 35 aa, Artificial Sequence
  Antimicrobial peptide sequence
GLPWILLRWLFRRGDNNNNNNGLARILLRLLFRFG

SEQ ID NO: 3928 - protein, 35 aa, Artificial Sequence
  Antimicrobial peptide sequence
GLPWILLRWLFRRGDNNNNNNGLVRILLRLLFRFG

SEQ ID NO: 3929 - protein, 35 aa, Artificial Sequence
  Antimicrobial peptide sequence
GLPWILLRWLFRRGDNNNNNNSLVRILLRLLLRFG

SEQ ID NO: 3930 - protein, 35 aa, Artificial Sequence
  Antimicrobial peptide sequence
GLPWILLRWLFRRGDNNNNNNGLVRILLRLLLRYG

SEQ ID NO: 3931 - protein, 35 aa, Artificial Sequence
  Antimicrobial peptide sequence
GLPWILLRWLFRRGDNNNNNNGLAWILLRWLFFRG

SEQ ID NO: 3932 - protein, 35 aa, Artificial Sequence
  Antimicrobial peptide sequence
GLPWILLRWLFRRGDNNNNNNGLVRILLRWLFFRG

SEQ ID NO: 3933 - protein, 35 aa, Artificial Sequence
  Antimicrobial peptide sequence
GLPWILLRWLFRRGDNNNNNNGLLRILLRWLFFRG

SEQ ID NO: 3934 - protein, 35 aa, Artificial Sequence
  Antimicrobial peptide sequence
GLPWILLRWLFRRGDNNNNNNGLPWILLRWLFRFG

SEQ ID NO: 3935 - protein, 35 aa, Artificial Sequence
  Antimicrobial peptide sequence
GLPWILLRWLFRRGDNNNNNNGLLRILLRWLFRFG

SEQ ID NO: 3936 - protein, 35 aa, Artificial Sequence
  Antimicrobial peptide sequence
GLPWILLRWLFRRGDNNNNNNGLPWILLRWLFRRG

SEQ ID NO: 3937 - protein, 36 aa, Artificial Sequence
  Antimicrobial peptide sequence
GLPWILLRWLFRRGDNNNNNNNGLPWILLRWLFFRG

SEQ ID NO: 3938 - protein, 36 aa, Artificial Sequence
  Antimicrobial peptide sequence
GLPWILLRWLFRRGDNNNNNNNGLARILLRWLFFRG

SEQ ID NO: 3939 - protein, 36 aa, Artificial Sequence
  Antimicrobial peptide sequence
GLPWILLRWLFRRGDNNNNNNNGLARILLRWLFRFG

SEQ ID NO: 3940 - protein, 36 aa, Artificial Sequence
  Antimicrobial peptide sequence
GLPWILLRWLFRRGDNNNNNNNGLVRILLRWLFRFG

SEQ ID NO: 3941 - protein, 36 aa, Artificial Sequence
  Antimicrobial peptide sequence
GLPWILLRWLFRRGDNNNNNNNGLARILLRLLFFRG

SEQ ID NO: 3942 - protein, 36 aa, Artificial Sequence
  Antimicrobial peptide sequence
GLPWILLRWLFRRGDNNNNNNNGLARILLRLLFRFG

SEQ ID NO: 3943 - protein, 36 aa, Artificial Sequence
  Antimicrobial peptide sequence
GLPWILLRWLFRRGDNNNNNNNGLVRILLRLLFRFG

SEQ ID NO: 3944 - protein, 36 aa, Artificial Sequence
  Antimicrobial peptide sequence
GLPWILLRWLFRRGDNNNNNNNSLVRILLRLLLRFG

SEQ ID NO: 3945 - protein, 36 aa, Artificial Sequence
  Antimicrobial peptide sequence
GLPWILLRWLFRRGDNNNNNNNGLVRILLRLLLRYG

SEQ ID NO: 3946 - protein, 36 aa, Artificial Sequence
  Antimicrobial peptide sequence
GLPWILLRWLFRRGDNNNNNNNGLAWILLRWLFFRG

SEQ ID NO: 3947 - protein, 36 aa, Artificial Sequence
  Antimicrobial peptide sequence
GLPWILLRWLFRRGDNNNNNNNGLVRILLRWLFFRG

SEQ ID NO: 3948 - protein, 36 aa, Artificial Sequence
  Antimicrobial peptide sequence
GLPWILLRWLFRRGDNNNNNNNGLLRILLRWLFFRG

SEQ ID NO: 3949 - protein, 36 aa, Artificial Sequence
  Antimicrobial peptide sequence
GLPWILLRWLFRRGDNNNNNNNGLPWILLRWLFRFG

SEQ ID NO: 3950 - protein, 36 aa, Artificial Sequence
  Antimicrobial peptide sequence
GLPWILLRWLFRRGDNNNNNNNGLLRILLRWLFRFG

SEQ ID NO: 3951 - protein, 36 aa, Artificial Sequence
  Antimicrobial peptide sequence
GLPWILLRWLFRRGDNNNNNNNGLPWILLRWLFRRG

SEQ ID NO: 3952 - protein, 35 aa, Artificial Sequence
  Antimicrobial peptide sequence
GLPWILLRWLFRRGDNGNGNGGLPWILLRWLFFRG

SEQ ID NO: 3953 - protein, 35 aa, Artificial Sequence
  Antimicrobial peptide sequence
GLPWILLRWLFRRGDNGNGNGGLARILLRWLFFRG

SEQ ID NO: 3954 - protein, 35 aa, Artificial Sequence
  Antimicrobial peptide sequence
GLPWILLRWLFRRGDNGNGNGGLARILLRWLFRFG

SEQ ID NO: 3955 - protein, 35 aa, Artificial Sequence
  Antimicrobial peptide sequence
GLPWILLRWLFRRGDNGNGNGGLVRILLRWLFRFG

SEQ ID NO: 3956 - protein, 35 aa, Artificial Sequence
  Antimicrobial peptide sequence
GLPWILLRWLFRRGDNGNGNGGLARILLRLLFFRG

SEQ ID NO: 3957 - protein, 35 aa, Artificial Sequence
  Antimicrobial peptide sequence
GLPWILLRWLFRRGDNGNGNGGLARILLRLLFRFG

SEQ ID NO: 3958 - protein, 35 aa, Artificial Sequence
  Antimicrobial peptide sequence
GLPWILLRWLFRRGDNGNGNGGLVRILLRLLFRFG

SEQ ID NO: 3959 - protein, 35 aa, Artificial Sequence
  Antimicrobial peptide sequence
GLPWILLRWLFRRGDNGNGNGSLVRILLRLLLRFG

SEQ ID NO: 3960 - protein, 35 aa, Artificial Sequence
  Antimicrobial peptide sequence
GLPWILLRWLFRRGDNGNGNGGLVRILLRLLLRYG

SEQ ID NO: 3961 - protein, 35 aa, Artificial Sequence
  Antimicrobial peptide sequence
GLPWILLRWLFRRGDNGNGNGGLAWILLRWLFFRG

SEQ ID NO: 3962 - protein, 35 aa, Artificial Sequence
  Antimicrobial peptide sequence
GLPWILLRWLFRRGDNGNGNGGLVRILLRWLFFRG

SEQ ID NO: 3963 - protein, 35 aa, Artificial Sequence
  Antimicrobial peptide sequence
GLPWILLRWLFRRGDNGNGNGGLLRILLRWLFFRG

SEQ ID NO: 3964 - protein, 35 aa, Artificial Sequence
  Antimicrobial peptide sequence
GLPWILLRWLFRRGDNGNGNGGLPWILLRWLFRFG

SEQ ID NO: 3965 - protein, 35 aa, Artificial Sequence
  Antimicrobial peptide sequence
GLPWILLRWLFRRGDNGNGNGGLLRILLRWLFRFG

SEQ ID NO: 3966 - protein, 35 aa, Artificial Sequence
  Antimicrobial peptide sequence
GLPWILLRWLFRRGDNGNGNGGLPWILLRWLFRRG

SEQ ID NO: 3967 - protein, 35 aa, Artificial Sequence
  Antimicrobial peptide sequence
GLPWILLRWLFRRGDGNGNGNGLPWILLRWLFFRG

SEQ ID NO: 3968 - protein, 35 aa, Artificial Sequence
  Antimicrobial peptide sequence
GLPWILLRWLFRRGDGNGNGNGLARILLRWLFFRG

SEQ ID NO: 3969 - protein, 35 aa, Artificial Sequence
  Antimicrobial peptide sequence
GLPWILLRWLFRRGDGNGNGNGLARILLRWLFRFG

SEQ ID NO: 3970 - protein, 35 aa, Artificial Sequence
  Antimicrobial peptide sequence
GLPWILLRWLFRRGDGNGNGNGLVRILLRWLFRFG

SEQ ID NO: 3971 - protein, 35 aa, Artificial Sequence
  Antimicrobial peptide sequence
GLPWILLRWLFRRGDGNGNGNGLARILLRLLFFRG

SEQ ID NO: 3972 - protein, 35 aa, Artificial Sequence
  Antimicrobial peptide sequence
GLPWILLRWLFRRGDGNGNGNGLARILLRLLFRFG

SEQ ID NO: 3973 - protein, 35 aa, Artificial Sequence
  Antimicrobial peptide sequence
GLPWILLRWLFRRGDGNGNGNGLVRILLRLLFRFG

SEQ ID NO: 3974 - protein, 35 aa, Artificial Sequence
  Antimicrobial peptide sequence
GLPWILLRWLFRRGDGNGNGNSLVRILLRLLLRFG

SEQ ID NO: 3975 - protein, 35 aa, Artificial Sequence
  Antimicrobial peptide sequence
GLPWILLRWLFRRGDGNGNGNGLVRILLRLLLRYG

SEQ ID NO: 3976 - protein, 35 aa, Artificial Sequence
  Antimicrobial peptide sequence
GLPWILLRWLFRRGDGNGNGNGLAWILLRWLFFRG

SEQ ID NO: 3977 - protein, 35 aa, Artificial Sequence
  Antimicrobial peptide sequence
GLPWILLRWLFRRGDGNGNGNGLVRILLRWLFFRG

SEQ ID NO: 3978 - protein, 35 aa, Artificial Sequence
  Antimicrobial peptide sequence
GLPWILLRWLFRRGDGNGNGNGLLRILLRWLFFRG

SEQ ID NO: 3979 - protein, 35 aa, Artificial Sequence
  Antimicrobial peptide sequence
GLPWILLRWLFRRGDGNGNGNGLPWILLRWLFRFG

SEQ ID NO: 3980 - protein, 35 aa, Artificial Sequence
  Antimicrobial peptide sequence
GLPWILLRWLFRRGDGNGNGNGLLRILLRWLFRFG

SEQ ID NO: 3981 - protein, 35 aa, Artificial Sequence
  Antimicrobial peptide sequence
GLPWILLRWLFRRGDGNGNGNGLPWILLRWLFRRG

SEQ ID NO: 3982 - protein, 35 aa, Artificial Sequence
  Antimicrobial peptide sequence
GLPWILLRWLFRRGDSGSGSGGLPWILLRWLFFRG

SEQ ID NO: 3983 - protein, 35 aa, Artificial Sequence
  Antimicrobial peptide sequence
GLPWILLRWLFRRGDSGSGSGGLARILLRWLFFRG

SEQ ID NO: 3984 - protein, 35 aa, Artificial Sequence
  Antimicrobial peptide sequence
GLPWILLRWLFRRGDSGSGSGGLARILLRWLFRFG

SEQ ID NO: 3985 - protein, 35 aa, Artificial Sequence
  Antimicrobial peptide sequence
GLPWILLRWLFRRGDSGSGSGGLVRILLRWLFRFG

SEQ ID NO: 3986 - protein, 35 aa, Artificial Sequence
  Antimicrobial peptide sequence
GLPWILLRWLFRRGDSGSGSGGLARILLRLLFFRG

SEQ ID NO: 3987 - protein, 35 aa, Artificial Sequence
  Antimicrobial peptide sequence
GLPWILLRWLFRRGDSGSGSGGLARILLRLLFRFG

SEQ ID NO: 3988 - protein, 35 aa, Artificial Sequence
  Antimicrobial peptide sequence
GLPWILLRWLFRRGDSGSGSGGLVRILLRLLFRFG

SEQ ID NO: 3989 - protein, 35 aa, Artificial Sequence
  Antimicrobial peptide sequence
GLPWILLRWLFRRGDSGSGSGSLVRILLRLLLRFG

SEQ ID NO: 3990 - protein, 35 aa, Artificial Sequence
  Antimicrobial peptide sequence
GLPWILLRWLFRRGDSGSGSGGLVRILLRLLLRYG

SEQ ID NO: 3991 - protein, 35 aa, Artificial Sequence
  Antimicrobial peptide sequence
GLPWILLRWLFRRGDSGSGSGGLAWILLRWLFFRG

SEQ ID NO: 3992 - protein, 35 aa, Artificial Sequence
  Antimicrobial peptide sequence
GLPWILLRWLFRRGDSGSGSGGLVRILLRWLFFRG

SEQ ID NO: 3993 - protein, 35 aa, Artificial Sequence
  Antimicrobial peptide sequence
GLPWILLRWLFRRGDSGSGSGGLLRILLRWLFFRG

SEQ ID NO: 3994 - protein, 35 aa, Artificial Sequence
  Antimicrobial peptide sequence
GLPWILLRWLFRRGDSGSGSGGLPWILLRWLFRFG

SEQ ID NO: 3995 - protein, 35 aa, Artificial Sequence
  Antimicrobial peptide sequence
GLPWILLRWLFRRGDSGSGSGGLLRILLRWLFRFG

SEQ ID NO: 3996 - protein, 35 aa, Artificial Sequence
  Antimicrobial peptide sequence
GLPWILLRWLFRRGDSGSGSGGLPWILLRWLFRRG

SEQ ID NO: 3997 - protein, 35 aa, Artificial Sequence
  Antimicrobial peptide sequence
GLPWILLRWLFRRGDGSGSGSGLPWILLRWLFFRG

SEQ ID NO: 3998 - protein, 35 aa, Artificial Sequence
  Antimicrobial peptide sequence
GLPWILLRWLFRRGDGSGSGSGLARILLRWLFFRG

SEQ ID NO: 3999 - protein, 35 aa, Artificial Sequence
  Antimicrobial peptide sequence
GLPWILLRWLFRRGDGSGSGSGLARILLRWLFRFG

SEQ ID NO: 4000 - protein, 35 aa, Artificial Sequence
  Antimicrobial peptide sequence
GLPWILLRWLFRRGDGSGSGSGLVRILLRWLFRFG

SEQ ID NO: 4001 - protein, 35 aa, Artificial Sequence
  Antimicrobial peptide sequence
GLPWILLRWLFRRGDGSGSGSGLARILLRLLFFRG

SEQ ID NO: 4002 - protein, 35 aa, Artificial Sequence
  Antimicrobial peptide sequence
GLPWILLRWLFRRGDGSGSGSGLARILLRLLFRFG

SEQ ID NO: 4003 - protein, 35 aa, Artificial Sequence
  Antimicrobial peptide sequence
GLPWILLRWLFRRGDGSGSGSGLVRILLRLLFRFG

SEQ ID NO: 4004 - protein, 35 aa, Artificial Sequence
  Antimicrobial peptide sequence
GLPWILLRWLFRRGDGSGSGSSLVRILLRLLLRFG

SEQ ID NO: 4005 - protein, 35 aa, Artificial Sequence
  Antimicrobial peptide sequence
GLPWILLRWLFRRGDGSGSGSGLVRILLRLLLRYG

SEQ ID NO: 4006 - protein, 35 aa, Artificial Sequence
  Antimicrobial peptide sequence
GLPWILLRWLFRRGDGSGSGSGLAWILLRWLFFRG

SEQ ID NO: 4007 - protein, 35 aa, Artificial Sequence
  Antimicrobial peptide sequence
GLPWILLRWLFRRGDGSGSGSGLVRILLRWLFFRG

SEQ ID NO: 4008 - protein, 35 aa, Artificial Sequence
  Antimicrobial peptide sequence
GLPWILLRWLFRRGDGSGSGSGLLRILLRWLFFRG

SEQ ID NO: 4009 - protein, 35 aa, Artificial Sequence
  Antimicrobial peptide sequence
GLPWILLRWLFRRGDGSGSGSGLPWILLRWLFRFG

SEQ ID NO: 4010 - protein, 35 aa, Artificial Sequence
  Antimicrobial peptide sequence
GLPWILLRWLFRRGDGSGSGSGLLRILLRWLFRFG

SEQ ID NO: 4011 - protein, 35 aa, Artificial Sequence
  Antimicrobial peptide sequence
GLPWILLRWLFRRGDGSGSGSGLPWILLRWLFRRG

SEQ ID NO: 4012 - protein, 35 aa, Artificial Sequence
  Antimicrobial peptide sequence
GLPWILLRWLFRRGDSNSNSNGLPWILLRWLFFRG

SEQ ID NO: 4013 - protein, 35 aa, Artificial Sequence
  Antimicrobial peptide sequence
GLPWILLRWLFRRGDSNSNSNGLARILLRWLFFRG

SEQ ID NO: 4014 - protein, 35 aa, Artificial Sequence
  Antimicrobial peptide sequence
GLPWILLRWLFRRGDSNSNSNGLARILLRWLFRFG

SEQ ID NO: 4015 - protein, 35 aa, Artificial Sequence
  Antimicrobial peptide sequence
GLPWILLRWLFRRGDSNSNSNGLVRILLRWLFRFG

SEQ ID NO: 4016 - protein, 35 aa, Artificial Sequence
  Antimicrobial peptide sequence
GLPWILLRWLFRRGDSNSNSNGLARILLRLLFFRG

SEQ ID NO: 4017 - protein, 35 aa, Artificial Sequence
  Antimicrobial peptide sequence
GLPWILLRWLFRRGDSNSNSNGLARILLRLLFRFG

SEQ ID NO: 4018 - protein, 35 aa, Artificial Sequence
  Antimicrobial peptide sequence
GLPWILLRWLFRRGDSNSNSNGLVRILLRLLFRFG

SEQ ID NO: 4019 - protein, 35 aa, Artificial Sequence
  Antimicrobial peptide sequence
GLPWILLRWLFRRGDSNSNSNSLVRILLRLLLRFG

SEQ ID NO: 4020 - protein, 35 aa, Artificial Sequence
  Antimicrobial peptide sequence
GLPWILLRWLFRRGDSNSNSNGLVRILLRLLLRYG

SEQ ID NO: 4021 - protein, 35 aa, Artificial Sequence
  Antimicrobial peptide sequence
GLPWILLRWLFRRGDSNSNSNGLAWILLRWLFFRG

SEQ ID NO: 4022 - protein, 35 aa, Artificial Sequence
  Antimicrobial peptide sequence
GLPWILLRWLFRRGDSNSNSNGLVRILLRWLFFRG

SEQ ID NO: 4023 - protein, 35 aa, Artificial Sequence
  Antimicrobial peptide sequence
GLPWILLRWLFRRGDSNSNSNGLLRILLRWLFFRG

SEQ ID NO: 4024 - protein, 35 aa, Artificial Sequence
  Antimicrobial peptide sequence
GLPWILLRWLFRRGDSNSNSNGLPWILLRWLFRFG

SEQ ID NO: 4025 - protein, 35 aa, Artificial Sequence
  Antimicrobial peptide sequence
GLPWILLRWLFRRGDSNSNSNGLLRILLRWLFRFG

SEQ ID NO: 4026 - protein, 35 aa, Artificial Sequence
  Antimicrobial peptide sequence
GLPWILLRWLFRRGDSNSNSNGLPWILLRWLFRRG

SEQ ID NO: 4027 - protein, 35 aa, Artificial Sequence
  Antimicrobial peptide sequence
GLPWILLRWLFRRGDNSNSNSGLPWILLRWLFFRG

SEQ ID NO: 4028 - protein, 35 aa, Artificial Sequence
  Antimicrobial peptide sequence
GLPWILLRWLFRRGDNSNSNSGLARILLRWLFFRG

SEQ ID NO: 4029 - protein, 35 aa, Artificial Sequence
  Antimicrobial peptide sequence
GLPWILLRWLFRRGDNSNSNSGLARILLRWLFRFG

SEQ ID NO: 4030 - protein, 35 aa, Artificial Sequence
  Antimicrobial peptide sequence
GLPWILLRWLFRRGDNSNSNSGLVRILLRWLFRFG

SEQ ID NO: 4031 - protein, 35 aa, Artificial Sequence
  Antimicrobial peptide sequence
GLPWILLRWLFRRGDNSNSNSGLARILLRLLFFRG

SEQ ID NO: 4032 - protein, 35 aa, Artificial Sequence
  Antimicrobial peptide sequence
GLPWILLRWLFRRGDNSNSNSGLARILLRLLFRFG

SEQ ID NO: 4033 - protein, 35 aa, Artificial Sequence
  Antimicrobial peptide sequence
GLPWILLRWLFRRGDNSNSNSGLVRILLRLLFRFG

SEQ ID NO: 4034 - protein, 35 aa, Artificial Sequence
  Antimicrobial peptide sequence
GLPWILLRWLFRRGDNSNSNSSLVRILLRLLLRFG

SEQ ID NO: 4035 - protein, 35 aa, Artificial Sequence
  Antimicrobial peptide sequence
GLPWILLRWLFRRGDNSNSNSGLVRILLRLLLRYG

SEQ ID NO: 4036 - protein, 35 aa, Artificial Sequence
  Antimicrobial peptide sequence
GLPWILLRWLFRRGDNSNSNSGLAWILLRWLFFRG

SEQ ID NO: 4037 - protein, 35 aa, Artificial Sequence
  Antimicrobial peptide sequence
GLPWILLRWLFRRGDNSNSNSGLVRILLRWLFFRG

SEQ ID NO: 4038 - protein, 35 aa, Artificial Sequence
  Antimicrobial peptide sequence
GLPWILLRWLFRRGDNSNSNSGLLRILLRWLFFRG

SEQ ID NO: 4039 - protein, 35 aa, Artificial Sequence
  Antimicrobial peptide sequence
GLPWILLRWLFRRGDNSNSNSGLPWILLRWLFRFG

SEQ ID NO: 4040 - protein, 35 aa, Artificial Sequence
  Antimicrobial peptide sequence
GLPWILLRWLFRRGDNSNSNSGLLRILLRWLFRFG

SEQ ID NO: 4041 - protein, 35 aa, Artificial Sequence
  Antimicrobial peptide sequence
GLPWILLRWLFRRGDNSNSNSGLPWILLRWLFRRG

SEQ ID NO: 4042 - protein, 35 aa, Artificial Sequence
  Antimicrobial peptide sequence
GLPWILLRWLFRRGDHGHGHGGLPWILLRWLFFRG

SEQ ID NO: 4043 - protein, 35 aa, Artificial Sequence
  Antimicrobial peptide sequence
GLPWILLRWLFRRGDHGHGHGGLARILLRWLFFRG

SEQ ID NO: 4044 - protein, 35 aa, Artificial Sequence
  Antimicrobial peptide sequence
GLPWILLRWLFRRGDHGHGHGGLARILLRWLFRFG

SEQ ID NO: 4045 - protein, 35 aa, Artificial Sequence
  Antimicrobial peptide sequence
GLPWILLRWLFRRGDHGHGHGGLVRILLRWLFRFG

SEQ ID NO: 4046 - protein, 35 aa, Artificial Sequence
  Antimicrobial peptide sequence
GLPWILLRWLFRRGDHGHGHGGLARILLRLLFFRG

SEQ ID NO: 4047 - protein, 35 aa, Artificial Sequence
  Antimicrobial peptide sequence
GLPWILLRWLFRRGDHGHGHGGLARILLRLLFRFG

SEQ ID NO: 4048 - protein, 35 aa, Artificial Sequence
  Antimicrobial peptide sequence
GLPWILLRWLFRRGDHGHGHGGLVRILLRLLFRFG

SEQ ID NO: 4049 - protein, 35 aa, Artificial Sequence
  Antimicrobial peptide sequence
GLPWILLRWLFRRGDHGHGHGSLVRILLRLLLRFG

SEQ ID NO: 4050 - protein, 35 aa, Artificial Sequence
  Antimicrobial peptide sequence
GLPWILLRWLFRRGDHGHGHGGLVRILLRLLLRYG

SEQ ID NO: 4051 - protein, 35 aa, Artificial Sequence
  Antimicrobial peptide sequence
GLPWILLRWLFRRGDHGHGHGGLAWILLRWLFFRG

SEQ ID NO: 4052 - protein, 35 aa, Artificial Sequence
  Antimicrobial peptide sequence
GLPWILLRWLFRRGDHGHGHGGLVRILLRWLFFRG

SEQ ID NO: 4053 - protein, 35 aa, Artificial Sequence
  Antimicrobial peptide sequence
GLPWILLRWLFRRGDHGHGHGGLLRILLRWLFFRG

SEQ ID NO: 4054 - protein, 35 aa, Artificial Sequence
  Antimicrobial peptide sequence
GLPWILLRWLFRRGDHGHGHGGLPWILLRWLFRFG

SEQ ID NO: 4055 - protein, 35 aa, Artificial Sequence
  Antimicrobial peptide sequence
GLPWILLRWLFRRGDHGHGHGGLLRILLRWLFRFG

SEQ ID NO: 4056 - protein, 35 aa, Artificial Sequence
  Antimicrobial peptide sequence
GLPWILLRWLFRRGDHGHGHGGLPWILLRWLFRRG

SEQ ID NO: 4057 - protein, 35 aa, Artificial Sequence
  Antimicrobial peptide sequence
GLPWILLRWLFRRGDGHGHGHGLPWILLRWLFFRG

SEQ ID NO: 4058 - protein, 35 aa, Artificial Sequence
  Antimicrobial peptide sequence
GLPWILLRWLFRRGDGHGHGHGLARILLRWLFFRG

SEQ ID NO: 4059 - protein, 35 aa, Artificial Sequence
  Antimicrobial peptide sequence
GLPWILLRWLFRRGDGHGHGHGLARILLRWLFRFG

SEQ ID NO: 4060 - protein, 35 aa, Artificial Sequence
  Antimicrobial peptide sequence
GLPWILLRWLFRRGDGHGHGHGLVRILLRWLFRFG

SEQ ID NO: 4061 - protein, 35 aa, Artificial Sequence
  Antimicrobial peptide sequence
GLPWILLRWLFRRGDGHGHGHGLARILLRLLFFRG

SEQ ID NO: 4062 - protein, 35 aa, Artificial Sequence
  Antimicrobial peptide sequence
GLPWILLRWLFRRGDGHGHGHGLARILLRLLFRFG

SEQ ID NO: 4063 - protein, 35 aa, Artificial Sequence
  Antimicrobial peptide sequence
GLPWILLRWLFRRGDGHGHGHGLVRILLRLLFRFG

SEQ ID NO: 4064 - protein, 35 aa, Artificial Sequence
  Antimicrobial peptide sequence
GLPWILLRWLFRRGDGHGHGHSLVRILLRLLLRFG

SEQ ID NO: 4065 - protein, 35 aa, Artificial Sequence
  Antimicrobial peptide sequence
GLPWILLRWLFRRGDGHGHGHGLVRILLRLLLRYG

SEQ ID NO: 4066 - protein, 35 aa, Artificial Sequence
  Antimicrobial peptide sequence
GLPWILLRWLFRRGDGHGHGHGLAWILLRWLFFRG

SEQ ID NO: 4067 - protein, 35 aa, Artificial Sequence
  Antimicrobial peptide sequence
GLPWILLRWLFRRGDGHGHGHGLVRILLRWLFFRG

SEQ ID NO: 4068 - protein, 35 aa, Artificial Sequence
  Antimicrobial peptide sequence
GLPWILLRWLFRRGDGHGHGHGLLRILLRWLFFRG

SEQ ID NO: 4069 - protein, 35 aa, Artificial Sequence
  Antimicrobial peptide sequence
GLPWILLRWLFRRGDGHGHGHGLPWILLRWLFRFG

SEQ ID NO: 4070 - protein, 35 aa, Artificial Sequence
  Antimicrobial peptide sequence
GLPWILLRWLFRRGDGHGHGHGLLRILLRWLFRFG

SEQ ID NO: 4071 - protein, 35 aa, Artificial Sequence
  Antimicrobial peptide sequence
GLPWILLRWLFRRGDGHGHGHGLPWILLRWLFRRG

SEQ ID NO: 4072 - protein, 35 aa, Artificial Sequence
  Antimicrobial peptide sequence
GLPWILLRWLFRRGDHNHNHNGLPWILLRWLFFRG

SEQ ID NO: 4073 - protein, 35 aa, Artificial Sequence
  Antimicrobial peptide sequence
GLPWILLRWLFRRGDHNHNHNGLARILLRWLFFRG

SEQ ID NO: 4074 - protein, 35 aa, Artificial Sequence
  Antimicrobial peptide sequence
GLPWILLRWLFRRGDHNHNHNGLARILLRWLFRFG

SEQ ID NO: 4075 - protein, 35 aa, Artificial Sequence
  Antimicrobial peptide sequence
GLPWILLRWLFRRGDHNHNHNGLVRILLRWLFRFG

SEQ ID NO: 4076 - protein, 35 aa, Artificial Sequence
  Antimicrobial peptide sequence
GLPWILLRWLFRRGDHNHNHNGLARILLRLLFFRG

SEQ ID NO: 4077 - protein, 35 aa, Artificial Sequence
  Antimicrobial peptide sequence
GLPWILLRWLFRRGDHNHNHNGLARILLRLLFRFG

SEQ ID NO: 4078 - protein, 35 aa, Artificial Sequence
  Antimicrobial peptide sequence
GLPWILLRWLFRRGDHNHNHNGLVRILLRLLFRFG

SEQ ID NO: 4079 - protein, 35 aa, Artificial Sequence
  Antimicrobial peptide sequence
GLPWILLRWLFRRGDHNHNHNSLVRILLRLLLRFG

SEQ ID NO: 4080 - protein, 35 aa, Artificial Sequence
  Antimicrobial peptide sequence
GLPWILLRWLFRRGDHNHNHNGLVRILLRLLLRYG

SEQ ID NO: 4081 - protein, 35 aa, Artificial Sequence
  Antimicrobial peptide sequence
GLPWILLRWLFRRGDHNHNHNGLAWILLRWLFFRG

SEQ ID NO: 4082 - protein, 35 aa, Artificial Sequence
  Antimicrobial peptide sequence
GLPWILLRWLFRRGDHNHNHNGLVRILLRWLFFRG

SEQ ID NO: 4083 - protein, 35 aa, Artificial Sequence
  Antimicrobial peptide sequence
GLPWILLRWLFRRGDHNHNHNGLLRILLRWLFFRG

SEQ ID NO: 4084 - protein, 35 aa, Artificial Sequence
  Antimicrobial peptide sequence
GLPWILLRWLFRRGDHNHNHNGLPWILLRWLFRFG

SEQ ID NO: 4085 - protein, 35 aa, Artificial Sequence
  Antimicrobial peptide sequence
GLPWILLRWLFRRGDHNHNHNGLLRILLRWLFRFG

SEQ ID NO: 4086 - protein, 35 aa, Artificial Sequence
  Antimicrobial peptide sequence
GLPWILLRWLFRRGDHNHNHNGLPWILLRWLFRRG

SEQ ID NO: 4087 - protein, 35 aa, Artificial Sequence
  Antimicrobial peptide sequence
GLPWILLRWLFRRGDNHNHNHGLPWILLRWLFFRG

SEQ ID NO: 4088 - protein, 35 aa, Artificial Sequence
  Antimicrobial peptide sequence
GLPWILLRWLFRRGDNHNHNHGLARILLRWLFFRG

SEQ ID NO: 4089 - protein, 35 aa, Artificial Sequence
  Antimicrobial peptide sequence
GLPWILLRWLFRRGDNHNHNHGLARILLRWLFRFG

SEQ ID NO: 4090 - protein, 35 aa, Artificial Sequence
  Antimicrobial peptide sequence
GLPWILLRWLFRRGDNHNHNHGLVRILLRWLFRFG

SEQ ID NO: 4091 - protein, 35 aa, Artificial Sequence
  Antimicrobial peptide sequence
GLPWILLRWLFRRGDNHNHNHGLARILLRLLFFRG

SEQ ID NO: 4092 - protein, 35 aa, Artificial Sequence
  Antimicrobial peptide sequence
GLPWILLRWLFRRGDNHNHNHGLARILLRLLFRFG

SEQ ID NO: 4093 - protein, 35 aa, Artificial Sequence
  Antimicrobial peptide sequence
GLPWILLRWLFRRGDNHNHNHGLVRILLRLLFRFG

SEQ ID NO: 4094 - protein, 35 aa, Artificial Sequence
  Antimicrobial peptide sequence
GLPWILLRWLFRRGDNHNHNHSLVRILLRLLLRFG

SEQ ID NO: 4095 - protein, 35 aa, Artificial Sequence
  Antimicrobial peptide sequence
GLPWILLRWLFRRGDNHNHNHGLVRILLRLLLRYG

SEQ ID NO: 4096 - protein, 35 aa, Artificial Sequence
  Antimicrobial peptide sequence
GLPWILLRWLFRRGDNHNHNHGLAWILLRWLFFRG

SEQ ID NO: 4097 - protein, 35 aa, Artificial Sequence
  Antimicrobial peptide sequence
GLPWILLRWLFRRGDNHNHNHGLVRILLRWLFFRG

SEQ ID NO: 4098 - protein, 35 aa, Artificial Sequence
  Antimicrobial peptide sequence
GLPWILLRWLFRRGDNHNHNHGLLRILLRWLFFRG

SEQ ID NO: 4099 - protein, 35 aa, Artificial Sequence
  Antimicrobial peptide sequence
GLPWILLRWLFRRGDNHNHNHGLPWILLRWLFRFG

SEQ ID NO: 4100 - protein, 35 aa, Artificial Sequence
  Antimicrobial peptide sequence
GLPWILLRWLFRRGDNHNHNHGLLRILLRWLFRFG

SEQ ID NO: 4101 - protein, 35 aa, Artificial Sequence
  Antimicrobial peptide sequence
GLPWILLRWLFRRGDNHNHNHGLPWILLRWLFRRG

SEQ ID NO: 4102 - protein, 14 aa, Artificial Sequence
  Antimicrobial peptide sequence
  MISC_FEATURE (2)..(2): Xaa is Leu or Ile
  MISC_FEATURE (3)..(3): Xaa is Ala, Val, Leu, Ile or Pro
  MISC_FEATURE (4)..(4): Xaa is Arg or Trp
  MISC_FEATURE (5)..(5): Xaa is Leu or Ile
  MISC_FEATURE (6)..(6): Xaa is Leu or Ile
  MISC_FEATURE (7)..(7): Xaa is Leu or Ile
  MISC_FEATURE (9)..(9): Xaa is Trp, Ile or Leu
  MISC_FEATURE (10)..(10): Xaa is Leu or Ile
  MISC_FEATURE (11)..(11): Xaa is Phe or Trp
  MISC_FEATURE (13)..(13): Xaa is Phe, Trp or Arg
GXXXXXXRXXXRXG

What is claimed is:

1. An antimicrobial composition comprising an antibiotic peptide, wherein the peptide comprises a synthetic amino acid sequence having the sequence of formula 1

$$\text{Gly-}X_1\text{-}X_2\text{-}X_3\text{-}X_1\text{-}X_1\text{-}X_1\text{-Arg-}X_4\text{-}X_1\text{-}X_5\text{-Arg-}X_6\text{-Gly} \quad \text{(SEQ ID NO:4102)}$$

wherein
$X_1$ is selected from the group of Leu or Ile,
$X_2$ is selected from the group of Ala, Val, Leu, Ile, or Pro,
$X_3$ is selected from the group of Arg or Trp,
$X_4$ is selected from the group of Trp, Ile, or Leu
$X_5$ is selected from the group of Phe or Trp, and
$X_6$ is selected from the group of Phe, Trp, or Arg.

2. The antimicrobial composition of claim 1, wherein the composition inhibits growth of bacteria.

3. The antimicrobial composition of claim 1 wherein the bacteria are selected from the group consisting of *Pseudomonas, Escherichia, Staphylococcus, Streptococcus, Enterococcus, Mycobacteria, Haemophilus*, and combinations thereof.

4. The antimicrobial composition of claim 1, wherein the synthetic amino acid sequence has at least 85% sequence identity to SEQ ID NO: 8.

5. A method for inhibiting growth of bacteria comprising contacting the bacteria, for a time and under conditions effective to inhibit bacterial growth, with a composition comprising a synthetic amino acid sequence having the sequence of formula 1

$$\text{Gly-}X_1\text{-}X_2\text{-}X_3\text{-}X_1\text{-}X_1\text{-}X_1\text{-Arg-}X_4\text{-}X_1\text{-}X_5\text{-Arg-}X_6\text{-Gly} \quad \text{(SEQ ID NO:4102)}$$

wherein
$X_1$ is selected from the group of Leu or Ile,
$X_2$ is selected from the group of Ala, Val, Leu, Ile, or Pro,
$X_3$ is selected from the group of Arg or Trp,
$X_4$ is selected from the group of Trp, Ile, or Leu
$X_5$ is selected from the group of Phe or Trp, and
$X_6$ is selected from the group of Phe, Trp, or Arg.

6. The method of claim 5, wherein the bacteria are selected from the group consisting of *Pseudomonas, Escherichia, Staphylococcus, Streptococcus, Enterococcus, Mycobacteria, Haemophilus*, and combinations thereof.

7. The method of claim 6, wherein the bacteria are selected from the group consisting of *Streptococcus agalactiae, Staphylococcus aureus, Enterobacter aerogenes, Klebsiella pneumoniae, Actinomyces pyogenes, Streptococcus uberis, Streptococcus dysgalactiae*, and combinations thereof.

8. A method of treating microbial infection, the method comprising:
   a. identifying a subject having a microbial infection; and,
   b. administering a therapeutically effective amount of an antibiotic composition to the subject, wherein the antibiotic composition comprises a synthetic peptide having the sequence of formula 1:

$$\text{Gly-}X_1\text{-}X_2\text{-}X_3\text{-}X_1\text{-}X_1\text{-}X_1\text{-Arg-}X_4\text{-}X_1\text{-}X_5\text{-Arg-}X_6\text{-Gly} \quad \text{(SEQ ID NO:4102)}$$

wherein
$X_1$ is selected from the group of Leu or Ile,
$X_2$ is selected from the group of Ala, Val, Leu, Ile, or Pro,
$X_3$ is selected from the group of Arg or Trp,
$X_4$ is selected from the group of Trp, Ile, or Leu
$X_5$ is selected from the group of Phe or Trp, and
$X_6$ is selected from the group of Phe, Trp, or Arg.

9. The method of claim 8 further comprising inhibiting the growth of a mastitis infection causing microorganism by at least 10%.

10. A method of treating mastitis, the method comprising:
    a. identifying a subject having mastitis; and,
    a. administering a therapeutically effective amount of an antibiotic composition to the subject, wherein the antibiotic composition comprises a synthetic peptide having the sequence of formula 1:

$$\text{Gly-}X_1\text{-}X_2\text{-}X_3\text{-}X_1\text{-}X_1\text{-}X_1\text{-Arg-}X_4\text{-}X_1\text{-}X_5\text{-Arg-}X_6\text{-Gly} \quad \text{(SEQ ID NO:4102)}$$

wherein
$X_1$ is selected from the group of Leu or Ile,
$X_2$ is selected from the group of Ala, Val, Leu, Ile, or Pro,
$X_3$ is selected from the group of Arg or Trp,
$X_4$ is selected from the group of Trp, Ile, or Leu
$X_5$ is selected from the group of Phe or Trp, and
$X_6$ is selected from the group of Phe, Trp, or Arg.

11. The method of claim 10, wherein the antibiotic composition is administered to the mammary tissue of the subject.

* * * * *